United States Patent
Nomura et al.

(10) Patent No.: US 9,392,790 B2
(45) Date of Patent: Jul. 19, 2016

(54) MOLECULAR ROADBLOCKS FOR RPON BINDING SITES

(75) Inventors: Christopher T. Nomura, Syracuse, NY (US); Benjamin R. Lundgren, Nampa, ID (US)

(73) Assignee: THE RESEARCH FOUNDATION FOR THE STATE UNIVERSITY OF NEW YORK, Syracuse, NY (US)

( * ) Notice: Subject to any disclaimer, the term of this patent is extended or adjusted under 35 U.S.C. 154(b) by 30 days.

(21) Appl. No.: 14/115,953

(22) PCT Filed: May 7, 2012

(86) PCT No.: PCT/US2012/036746
§ 371 (c)(1),
(2), (4) Date: Jan. 21, 2014

(87) PCT Pub. No.: WO2012/154651
PCT Pub. Date: Nov. 15, 2012

(65) Prior Publication Data
US 2014/0148380 A1    May 29, 2014

Related U.S. Application Data

(60) Provisional application No. 61/483,350, filed on May 6, 2011.

(51) Int. Cl.
| | | |
|---|---|---|
| A61K 38/00 | (2006.01) | |
| C07K 16/00 | (2006.01) | |
| A01N 37/46 | (2006.01) | |
| C12N 15/63 | (2006.01) | |
| C12N 9/12 | (2006.01) | |
| C12Q 1/68 | (2006.01) | |

(52) U.S. Cl.
CPC .............. *A01N 37/46* (2013.01); *C12N 9/1247* (2013.01); *C12N 15/63* (2013.01); *C12Q 1/6897* (2013.01)

(58) Field of Classification Search
None
See application file for complete search history.

(56) References Cited

U.S. PATENT DOCUMENTS

| 6,004,803 | A | 12/1999 | Klatzmann et al. |
| 6,994,985 | B1 | 2/2006 | Werner et al. |
| 7,517,684 | B2 * | 4/2009 | Rubenfield et al. ........... 435/325 |
| 2003/0023032 | A1 | 1/2003 | Bassler et al. |
| 2004/0157314 | A1 | 8/2004 | Bergeron et al. |
| 2007/0020624 | A1 * | 1/2007 | Rubenfield ............ C07K 14/21 435/6.15 |

FOREIGN PATENT DOCUMENTS

WO    2004/056960 A2    7/2004

OTHER PUBLICATIONS

Thompson, et. al. The alternative sigma factor RpoN regulates the quorum sensing gene rhlI in Pseudomonas aeruginosa, FEMS Microbiology Letters, 220 (2003) 187-195.*
Kelly, Journal of Bacteriology. 2000, p. 6503-6508vol. 182, No. 22.*
Thompson et. al. FEMS Microbiology Letters 220 (2003) 187-195.*
International Search Report and Written Opinion issued in PCT/US2012/036746, mailed Dec. 26, 2012.
Thompson et al., "The alternative sigma factor RpoN regulates the quorum sensing gene rhlI in *Pseudomonas aeruginosa*," *FEMS Microbiology Letters*, 220:187-195 (2003).

* cited by examiner

*Primary Examiner* — James Alstrum-Acevedo
*Assistant Examiner* — Jeanette Lieb
(74) *Attorney, Agent, or Firm* — Heslin Rothenberg Farley & Mesiti P.C.

(57) ABSTRACT

The present invention relates to, inter alia, a method for repressing transcription and/or gene expression from RpoN binding sites (or promoters) or cryptic promoters upstream of RpoN binding sites. The method comprises providing an agent that specifically and selectively binds to RpoN promoter sequences to inhibit or repress the expression of genes downstream of that promoter; and contacting the RpoN promoter with the agent. Agents for repressing transcription and/or gene expression from RpoN promoters are also provided. The agent can be a composition that binds specifically to the −24, −12, or −24/−12 site(s) for RpoN promoter interference. Synthetic peptides, vectors, and host cells are also provided.

13 Claims, 25 Drawing Sheets

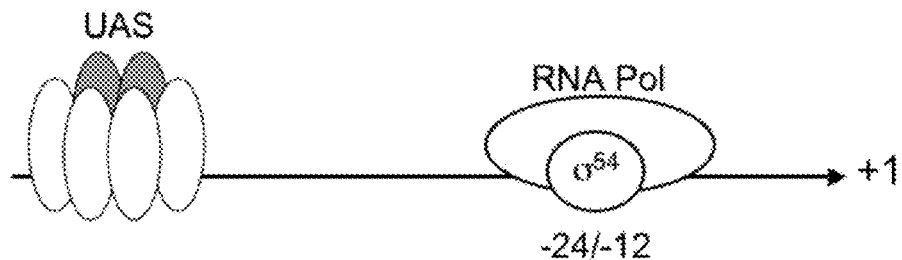
FIG. 1
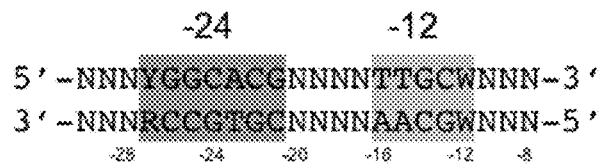
FIG. 2
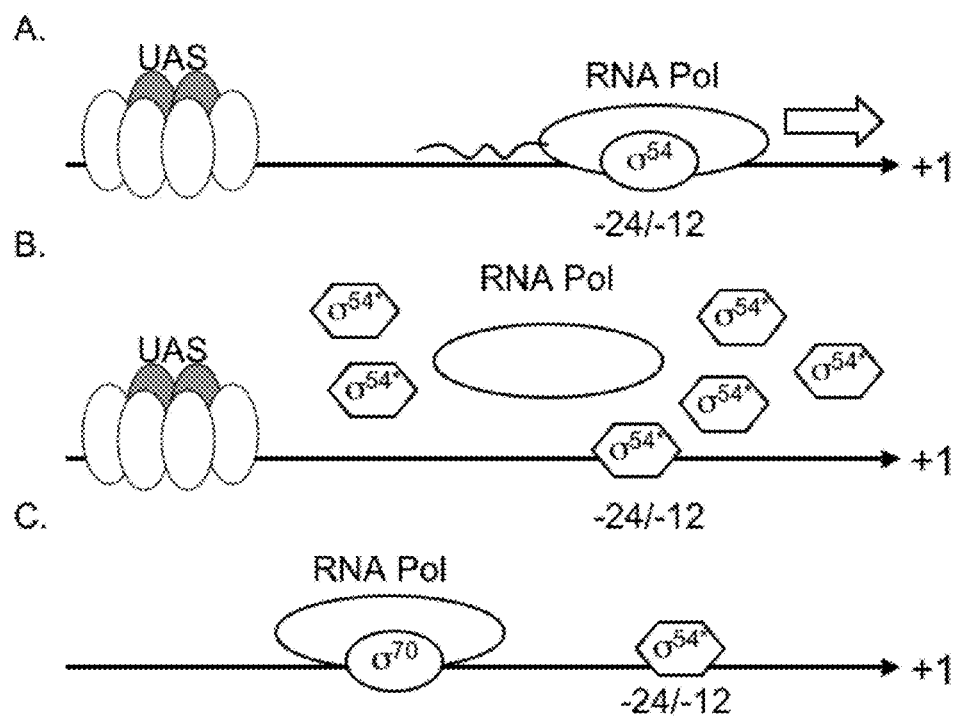
FIGS. 3A-C

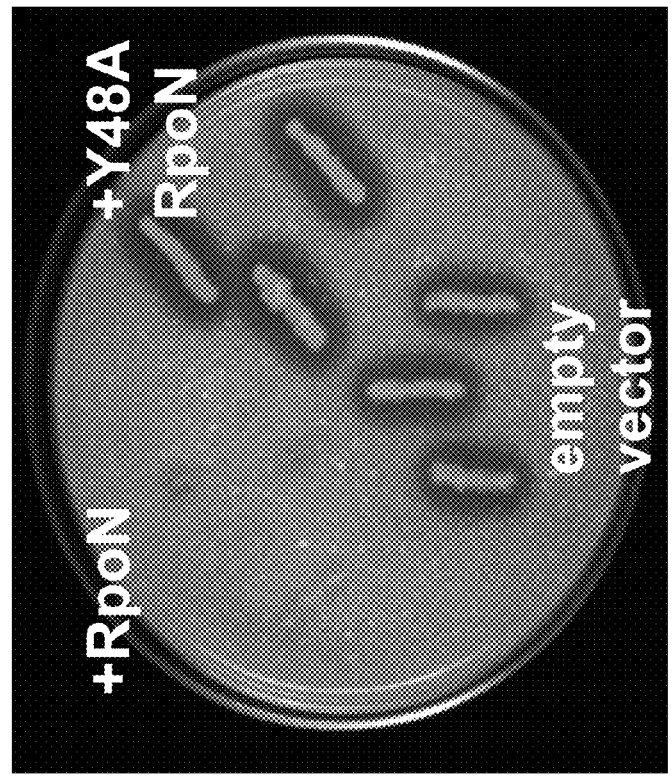
FIG. 9

RpoN-deficient bacterium: | With the RpoN molecular roadblock:
---|---

A. Genes can be transcribed by other promoters

*Cryptic promoters can activate RpoN-regulated genes*

B. Cannot detect antagonistic RpoN interactions i. at $\sigma^{70}$ promoters

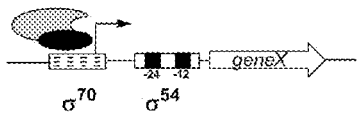

ii. with activator protein from RNAP:$\sigma^{70}$

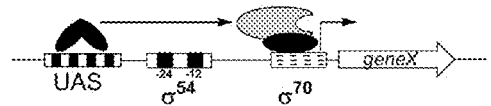

C. Higher RNAP:$\sigma^{70}$ increases transcription from $\sigma^{70}$ promoters

*sigma factor RNAP imbalance generates bias transcription data*

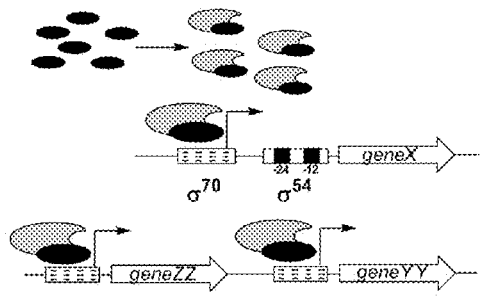

D. Genes are blocked from multiple promoters

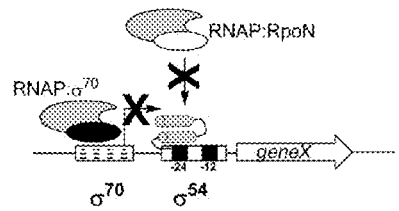

E. Antagonistic interactions can be observed i. blocking $\sigma^{70}$ promoters

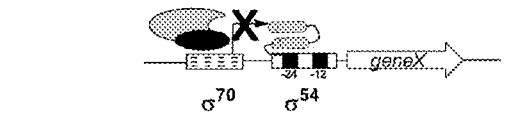

ii. blocking activator protein from RNAP:$\sigma^{70}$

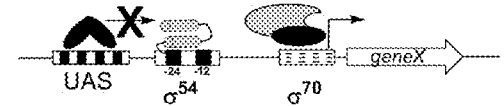

F. RNAP:sigma factor complexes are in normal balance

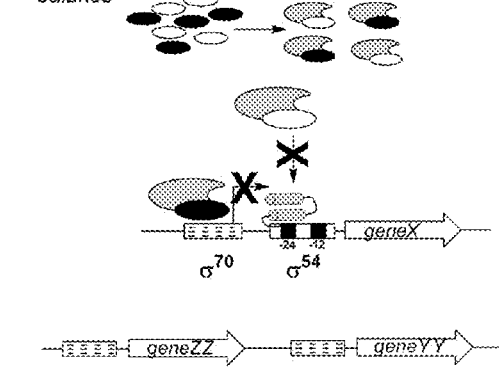

FIG. 19

|  |  | Downfold-change | |
| --- | --- | --- | --- |
| Genes | Function | ΔrpoN | wt |
| PhzA2B2C2D2E2F2 | phenazine biosynthesis | -9 | -62 |
| PA1677 | Isochorismatase hydrolase | -5 | -2 |
| PA2069 | carbamoyltransferase | -4 | -6 |
| PA1869 | acyl carrier protein | -3 | -3 |
| OprG | outer membrane protein | -3 | -5 |
| PA1414 | hypothetical | -3 | -2 |
| Ppa | inorganic pyrophosphatase | -3 | -2 |
| PA4141 | hypothetical | -3 | -10 |
| PA3326 | hypothetical | -3 | -4 |
| PA1342 | amino acid transport | -3 | -12 |
| RhlR | QS transcriptional regulator | -3 | -4 |
| PA4463 | sigma 54 modulation protein | -3 | -4 |
| Idh | isocitrate dehydrogenase | -3 | NC |
| RhlA | rhamnosyltransferase | -2 | -5 |
| PckA | PEP carboxykinase | -2 | NC |
| PA2321 | glucokinase | -2 | NC |
| PA2805 | hypothetical | -2 | -4 |
| PA3309 | universal stress protein | -2 | -3 |
| PA2067 | hydrolase | -2 | -3 |
| PA2031 | hypothetical | -2 | -4 |
| PA0200 | hypothetical | -2 | -33 |
| PA4348 | metallo-beta-lactamase superfamily protein | -2 | NC |
| GlyA3 | serine hydroxymethyltransferase | -2 | NC |
| PA0542 | hypothetical | -2 | -3 |
| AlgP | alginate regulatory protein | -2 | -3 |
| Anr | anaerboic transition | -2 | -2 |
| PA0102 | carbonic anhydrase | -2 | NC |
| PA2604 | hypothetical | -2 | -10 |
| PA0459 | ClpA/B protease ATP binding subunit | -2 | -6 |
| PA5445 | succinyl-CoA:coenzyme A transferase | -2 | 2 |
| AceA | isocitrate lyase | -2 | -2 |
| PA3665 | LysE transporter | -2 | NC |
| Rmf | ribosome modulation factor | -2 | -10 |

FIG. 28

MOLECULAR ROADBLOCKS FOR RPON BINDING SITES

CROSS-REFERENCE TO RELATED APPLICATIONS

This application is a U.S. National Phase filing under 35 U.S.C. §371 of International Application No. PCT/US2012/036746, filed May 7, 2012, and published as WO 2012/154651-A2 on Nov. 15, 2012, which claims benefit of priority from U.S. Provisional Patent Application Ser. No. 61/483,350, filed May 6, 2011. The entire contents of each of the prior applications are incorporated herein by reference in their entirety.

GOVERNMENT RIGHTS STATEMENT

This invention was made with Government support under grant number DMR0907085 awarded by the National Science Foundation. The Government has certain rights in the invention.

SEQUENCE LISTING

The instant application contains a lengthy Sequence Listing which has been submitted via text file (.txt) in lieu of a printed, paper (or .pdf) copy, and is hereby incorporated by reference in its entirety.

FIELD OF THE INVENTION

The present invention relates to molecular roadblocks for RpoN binding sites and uses thereof, including, inter alia, methods and tools for repressing gene transcription by targeting promoter activity. The invention further relates to agents, synthetic peptides, vectors, and host cells for repressing gene transcription.

BACKGROUND OF THE INVENTION

Bacterial pathogens cause a number of important diseases of humans, animals, and plants. Bacteria also contribute to the growth of unwanted biofilms, which can cause biofouling of coatings, water sources, and microbial influenced corrosion. The average bacterium has ~3500 genes that must be coordinately expressed in order for the organism to grow and respond to the environment. Therefore, understanding gene expression in bacteria is an important aspect in developing ways to control diseases and other problematic issues caused by bacteria.

Currently, there is a global rise in microbial resistance to antibiotics. The rapid evolution of resistant bacteria and the slow development of new antibiotics underscores the urgent need for new and innovative approaches to decrease microbial pathogenicity. Most traditional antibiotics act in one of two fashions: either as bacteriostatics that prevent bacterial cell division or as bactericides that kill the cell. Recently, there has been a movement to target quorum sensing (QS) since this does not control processes essential for the survival or growth of the cells (Njoroge et al., 2009, EMBO Mol Med 1(4): 201-210). All currently available antibiotics target a single process for the bacterial cells, e.g., cell wall synthesis, protein synthesis, quorum sensing, etc.

Since these methodologies target single cellular functions or structures, microbes can often evolve to evade the treatment. In addition, there is a dearth of defined targets to inhibit or limit bacterial response to the environment. There is therefore a need in the art for new approaches that address the limitations associated with traditional antibiotics. In particular, there is a need in the art for methods that can specifically interfere with the expression of genes involved in pathogenesis, motility, bacterial communication, biofilm production, and bacterial response to environmental stimuli.

The present invention is directed to overcoming these and other deficiencies in the art.

Citation or identification of any reference in this section, or in any other section of this application, shall not be considered an admission that such reference is available as prior art to the present invention.

SUMMARY OF THE INVENTION

The present invention relates to various methods, agents, compositions, synthetic peptides, and other tools that are effective in, inter alia, repressing gene transcription in bacteria. Gene expression in bacteria requires specialized proteins called sigma factors that direct the RNA polymerase (RNAP) to sites of transcription. Most sigma factors belong to the $\sigma^{70}$ family. Whereas bacteria have multiple $\sigma^{70}$-type sigma factors, they normally only have one functional copy of the alternative sigma factor, $\sigma^{54}$ or RpoN. The alternative sigma factor, $\sigma^{54}$ or RpoN, regulates a complex genetic network that extends into various facets of bacterial physiology, including metabolism, survival in strenuous environments, production of virulence factors, and formation of biofilms. And although RpoN is essential for expression of these phenotypic traits, definition of the transcriptional network governed by RpoN is limited to few examples, which focused on predictive models or expression of full-length native RpoN to identify sites of regulation.

In one aspect, to circumvent the inherent shortcomings of these approaches and gain global insight into RpoN regulation, the present invention provides, inter alia, a DNA-binding protein called the RpoN molecular roadblock that specifically targets RpoN promoters. The RpoN molecular roadblock antagonizes transcription from all genes possessing RpoN promoters thereby providing a genome-wide, temporal snapshot of RpoN regulation. The RpoN molecular roadblock of the present invention is useful for defining RpoN regulons for bacterial pathogens, including opportunistic pathogens, by using a combination of microarray transcriptome analysis and computational prediction. Use of the RpoN molecular roadblock of the present invention also is useful for identifying unprecedented control points for RpoN regulation. Also, because of the universal nature of RpoN transcription, the RpoN molecular roadblock of the present invention can be applied to any bacterium and will serve as an advantageous tool for discovering RpoN genetic networks.

The methods, agents, synthetic peptides, vectors, and host cells of the present invention can be used in medical, agricultural, and bioprocess industries and applications. For example, the present invention can be used to reduce or prevent biofilms produced by bacteria, as many of the genes encoding proteins associated with biofilm synthesis are regulated by RpoN promoters. Further, a number of plant and animal (including human) diseases are caused by pathogenic bacteria, which rely on virulence factors.

Further, since RpoN is a global transcriptional regulator and is necessary for full virulence in several human bacterial pathogens, the present invention provides important methods and tools useful to discover cryptic promoters and genes regulated by RpoN. By using the method to inhibit expression of genes regulated by RpoN promoters, genes can be identified via comparisons using art-known transcriptome analyzing technologies (e.g., real time sequencing, quantitative real time PCR (QRT PCR), microarray analysis).

The present invention can also be used to improve bioprocess applications such as protein and bioproduct production by decreasing metabolic burden of RpoN expressed genes in cells. By eliminating unnecessary burden from RpoN expressed genes, more energy can go towards bioproduct production.

Thus, in one aspect, the present invention relates to a method for repressing transcription or gene expression from a binding site of interest, where the binding site of interest is an RpoN binding site or a cryptic promoter upstream or downstream of an RpoN binding site. The method involves the steps of: (a) providing an agent that (i) specifically and selectively binds to a sequence comprised in the binding site of interest and (ii) inhibits or represses expression of genes regulated by the binding site of interest; and (b) contacting the agent to the binding site of interest. In some embodiments, said contacting comprises contacting the agent to a bacterial cell comprising the binding site of interest, wherein the agent is heterologous to the bacterial cell.

In another aspect, the present invention relates to an agent for repressing transcription and/or gene expression from a binding site of interest, where the binding site of interest is an RpoN binding site or a cryptic promoter upstream of an RpoN binding site.

In another aspect, the present invention relates to a composition comprising an agent for repressing transcription and/or gene expression, bound to a binding site of interest, where the binding site of interest is an RpoN binding site or a cryptic promoter upstream of an RpoN binding site. In some embodiments, the composition further comprises a bacterial cell comprising the agent bound to the RpoN binding site or a cryptic promoter upstream of an RpoN binding site, wherein the agent is heterologous to the bacterial cell.

In another aspect, provided herein is a composition comprising a bacterial cell comprising a heterologous agent bound to an RpoN binding site or a cryptic promoter upstream of an RpoN binding site, wherein said agent represses transcription and/or gene expression from the RpoN binding site or a cryptic promoter upstream of an RpoN binding site.

As used herein, the term "heterologous" refers to what is not normally found in nature. Accordingly, the term "heterologous agent" refers to an agent, for example, a heterologous protein, not normally found in a given cell in nature. As such, a heterologous agent may be: (a) foreign to its host cell (i.e., is "exogenous" to the cell); (b) naturally found in the host cell (i.e., "endogenous") but present at an unnatural quantity in the cell (i.e., greater or lesser quantity than naturally found in the host cell); or (c) naturally found in the host cell but positioned outside of its natural locus (e.g., an exogenous polynucleotide comprising a native gene sequence but encoding a heterologous protein).

In some embodiments, the heterologous agent bound to an RpoN binding site or a cryptic promoter upstream of an RpoN binding site can be any agent capable of repressing transcription and/or gene expression from an RpoN binding site or a cryptic promoter upstream of an RpoN binding site, as provided herein.

In some embodiments, the heterologous agent comprises: a synthetic peptide comprising an amino acid sequence that: (a) has 70-75%, 75-80%, 80-85%, 85-90%, 90-95% or 95-100% homology with an RpoN box of Region III of an RpoN protein; and (b) binds specifically to a −24, −12, or −24/−12 site(s) of an RpoN promoter, where the synthetic peptide is effective for repressing transcription and/or gene expression from a binding site of interest, and where the binding site of interest is an RpoN binding site or a cryptic promoter upstream of an RpoN binding site. In some embodiments, the amino acid sequence comprises the conserved amino acids from an RpoN box of Region III of an RpoN protein through the carboxy terminal amino acid residue of the RpoN protein. In some embodiments, the Region III comprises a modification to the heptad repeat overlapping the glutamine-rich or acid-rich motifs of an RpoN protein. In some embodiments, the amino acid sequence comprises at least 20 carboxy terminal amino acids of an RpoN protein. In some embodiments, the amino acid sequence binds specifically and selectively to a cryptic promoter upstream of an RpoN binding site. In some embodiments, the amino acid sequence comprises SEQ ID NO:10103 or a functional variant thereof. In some embodiments, the heterologous agent comprises an isolated nucleic acid molecule encoding the synthetic peptide described above. In some embodiments, the nucleic acid molecule comprises the nucleotide sequence of SEQ ID NO:10102.

In a further aspect, the present invention relates to a method for identifying an agent for repressing transcription or expression of a gene of interest from a promoter of interest, where the promoter of interest comprises an RpoN binding site or a cryptic promoter upstream of an RpoN binding site. The method comprises the steps of: (a) transforming an expression vector into a bacterial cell of interest, where the expression vector comprises a reporter gene operably linked to a promoter comprising an RpoN binding site or a cryptic promoter upstream of an RpoN binding site; and (b) determining the expression of the reporter gene in the absence and presence of a candidate agent, respectively. In some embodiments, the candidate agent is identified as an agent for repressing transcription or expression of a gene of interest from an RpoN binding site or a cryptic promoter upstream of an RpoN binding site when expression of the reporter gene is modulated in the presence of the candidate agent. In some embodiments, the identified agent decreases expression of the reporter gene. In some embodiments, the bacterial cell of interest does not comprise a native RpoN protein.

In another aspect, the present invention relates to a method for identifying an RpoN −24 conserved nucleotide sequence element for use in a screening assay, where the screening assay screens for an agent of interest that binds to the RpoN −24 conserved nucleotide sequence. This method involves the steps of: (a) transforming a bacterial cell with an expression vector comprising a reporter gene, where the vector comprises a −24 nucleotide sequence element comprising GTTGGXXXXTT (where X is any nucleotide) positioned between a promoter and a ribosomal binding site (RBS) for the reporter gene; (b) contacting an RpoN protein or peptide to −24 element nucleotide sequence of the reporter gene construct; and (c) determining whether transcription mediated by the reporter gene promoter is impeded, thereby reducing expression of the reporter gene. In some embodiments, the −24 nucleotide sequence element comprising GTTGGXXXXTT is identified as an RpoN −24 conserved nucleotide sequence element when expression of the reporter gene is reduced.

In a further aspect, the present invention relates to a synthetic peptide comprising an amino acid sequence that: (a) has 70-75%, 75-80%, 80-85%, 85-90%, 90-95% or 95-100% homology with an RpoN box of Region III of an RpoN protein; and (b) binds specifically to a −24, −12, or −24/−12 site(s) of an RpoN promoter, where the synthetic peptide is effective for repressing transcription and/or gene expression from a binding site of interest, and where the binding site of interest is an RpoN binding site or a cryptic promoter upstream of an RpoN binding site.

In another aspect, the present invention relates to an isolated nucleic acid molecule encoding the synthetic peptide of the present invention.

In another aspect, the present invention relates to a vector comprising the isolated nucleic acid molecule encoding the synthetic peptide of the present invention.

In another aspect, the present invention relates to a host cell comprising the vector of the present invention.

In another aspect, the present invention relates to a method of using the synthetic peptide of the present invention for repressing transcription or gene expression from a binding site of interest, where the binding site of interest is an RpoN binding site or a cryptic promoter upstream or downstream of an RpoN binding site. The method involves the steps of: (a) providing the synthetic peptide according to the present invention; and (b) contacting the synthetic peptide to the binding site of interest, thereby repressing transcription or gene expression from the binding site of interest.

BRIEF DESCRIPTION OF THE DRAWINGS

The present invention is described herein with reference to the accompanying drawings, in which similar reference characters denote similar elements throughout the several views. It is to be understood that in some instances, various aspects of the invention may be shown exaggerated or enlarged to facilitate an understanding of the invention.

FIG. 1: Schematic of organization of RpoN ($\sigma^{54}$)-dependent promoters and activators. The RpoN ($\sigma^{54}$) protein binds to a specific nucleotide sequence binding site (promoter) located −24/−12 to the initiation site. Once bound, it recruits the RNA polymerase (RNA Pol). Specific activator proteins called enhancer binding proteins (EBPs) that bind to upstream activating sequences (UAS) are necessary activate transcription from the RpoN binding site.

FIG. 2: Consensus nucleotide sequence of the $\sigma^{54}$ binding site. The −24 (dark gray box) and −12 (light gray box) consensus sequences are shown. N, any nucleotide; R, purines; Y, pyrimidines; W is A or T.

FIGS. 3A-3C: Schematic of one embodiment. A. Normal transcription from the RpoN ($\sigma^{54}$) promoter as depicted in FIG. 1. B. Use of a compound, non-native, mutant protein, synthetic peptide, or other chemical compound capable of binding the RpoN promoter sequence (indicated by the hexagon $\sigma^{54*}$) that can antagonize transcription by the RNA polymerase. Once bound, the protein is unable to interact with the RNA polymerase or activator proteins, thus preventing transcription of the RpoN-specific locus. Multiple copies of the $\sigma^{54*}$ will titer out the RpoN promoter sites therefore repressing the transcription of all loci regulated by RpoN. C. In cases where genes or operons have more than one promoter, the $\sigma^{54*}$ can inhibit expression by physically blocking RNA polymerase holoenzyme associated with another sigma factor (in this example it is a $\sigma^{70}$ type sigma factor, but it may be any sigma factor that promotes transcription from upstream of the molecular roadblock. In some cases, the repression of the expressed gene will result in a lack of transcription from genes that would be under control of the repressed gene. For example, if the gene were an activator of transcription of other genes on the genome, the $\sigma^{54*}$ would prevent expression of that gene and any genes under its control. On the other hand, the blockage of a repressor would result in the expression of other genes in the genome, not normally expressed under those particular conditions.

FIG. 9: *P. aeruginosa* PAO1 growth on LB plates with 2% milk when expressing i) pBRL344 (empty vector), ii) truncated RpoN, or iii) Y48A RpoN.

FIG. 28: Genes that are antagonistically regulated by RpoN in *P. aeruginoisa*. To identify sites of antagonism via RpoN, the RpoN molecular roadblock was expressed in rpoN-deficient *P. aeruginosa*. The resulting transcriptome was then compared to a transcriptome generated by rpoN-deficient *P. aeruginosa* harboring empty plasmid. Genes displaying a magnitude of more than 2-fold change and possessing putative RpoN binding sites were categorized as sites of RpoN antagonism (ArpoN column). For comparison, relative fold changes are given for comparing the transcriptomes between wild-type *P. aeruginosa* with and without the RpoN molecular roadblock (wt column).

DETAILED DESCRIPTION OF THE INVENTION

Figure 4:
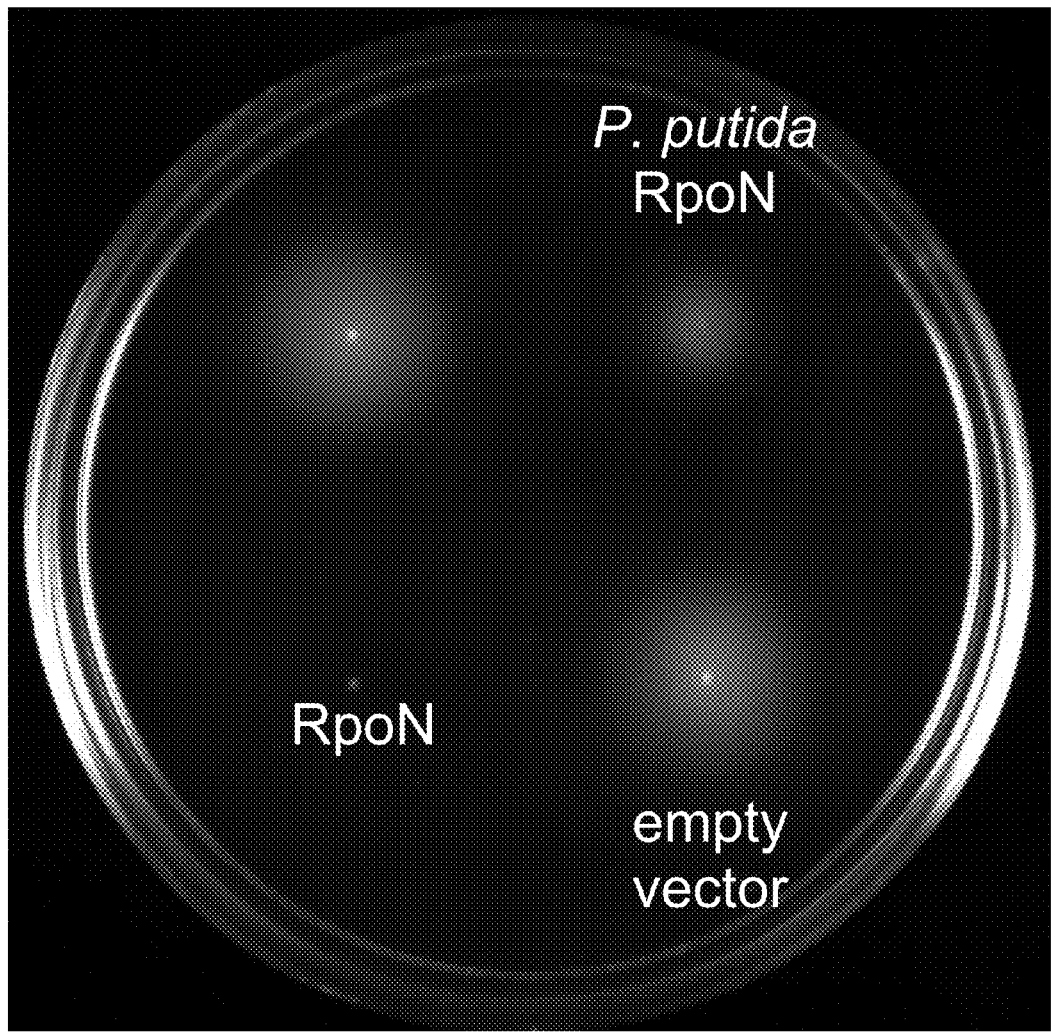
FIG. 4: Motility of *P. putida* KT2440 on M63 soft agar expressing i) empty vector, ii) native RpoN or iii) *M. xanthus* RpoN.

The present invention relates to molecular roadblocks for RpoN binding sites and uses thereof, including, inter alia, methods and tools for repressing gene transcription by targeting promoter activity. The invention further relates to agents, synthetic peptides, vectors, and host cells for repressing gene transcription.

Sigma Factors and RpoN ($\sigma^{54}$)

Sigma factors (a) are prokaryotic proteins that are necessary for transcription of prokaryotic genes. Sigma factors bind to specific nucleotide sequences in the DNA usually located −35/−10 and sometimes extended −10 from the initiation site called promoters and recruit the RNA polymerase to initiate transcription of specific genes (Gruber et al. 2003, Annu Rev Microbiol 57:441-466). Most sigma factor proteins belong to the RpoD or $\sigma^{70}$ family of proteins based on sequence similarity.

The alternative sigma factor RpoN (also known as $\sigma^{54}$, sig54, $\sigma^{N}$, NtrA, SigL) is a protein that also directs transcription in prokaryotic cells but is completely unrelated to the $\sigma^{70}$ family of proteins (Burrows, P. C., K. Severinov, A. Ishihama, M. Buck, and S. R. Wigneshweraraj. 2003. Mapping sigma 54-RNA polymerase interactions at the −24 consensus promoter element. J Biol Chem 278:29728-43). Although the RpoN protein also binds to a very specific nucleotide sequence binding site (−24/−12) and recruits the RNA polymerase in order to initiate transcription of specific genes, it must work in concert with transcriptional activators that often bind to a specific enhancer nucleotide sequences that are not located near the RpoN binding site (or promoter). These activators are a broad class of ATP activated proteins that allow the RpoN initiated transcription from a −24/−12 binding site to occur (FIG. 1). Thus, in contrast to the $\sigma^{70}$ family of proteins, whose members promote transcription from the −35/−10 sites and do so independently of an ATP energy source (Murakami, K. S., and S. A. Darst. 2003. Bacterial RNA polymerases: the whole story. Curr Opin Struct Biol 13:31-9), RpoN proteins must bind to their promoter and undergo a conformational change in the presence of specific ATP activated proteins to form an open transcription complex.

The RpoN protein has been shown to activate transcription of genes encoding proteins involved in nitrogen utilization and in pilin-, flagella-, and virulence-related factors in both plant and animal pathogens (Cases, I., D. W. Ussery, and V. de Lorenzo. 2003. The sigma54 regulon (sigmulon) of *Pseudomonas putida*. Environ Microbiol 5:1281-93; Hendrickson, E. L., J. Plotnikova, S. Mahajan-Miklos, L. G. Rahme, and F. M. Ausubel. 2001. Differential roles of the *Pseudomonas aeruginosa* PA14 rpoN gene in pathogenicity in plants, nematodes, insects, and mice. J Bacteriol 183:7126-34; Studholme, D. J., and M. Buck. 2000. The biology of enhancer-dependent transcriptional regulation in bacteria: insights from genome sequences. FEMS Microbiol Lett 186: 1-9). The protein interacts with a specific, conserved nucleotide sequence, the RpoN ($\sigma^{54}$) promoter or binding site (FIG. 2). The sequence is remarkably conserved with some nucleotides in the −24 and −12 sites>90% conserved across a number of bacterial species (Barrios, H., B. Valderrama, and E. Morett. 1999. Compilation and analysis of sigma(54)-dependent promoter sequences. Nucleic Acids Res 27:4305-13).

FIG. 2 shows a consensus sequence for an RpoN binding site. SEQ ID NOS. 1-9999 (which are 5'-3' sequences) and the 3'-5' complementary sequences thereof, are examples of consensus sequences for RpoN binding sites that can be targeted using the methods of the invention. In one instance, the consensus sequence is −12 from the initiation site. In another embodiment, the consensus sequence is located 20-600 bp from the initiation site.

In another instance, the consensus sequence is 20-30 nucleotides in length. In other instances, the consensus sequence can be 20, 21, 22, 23, 24, 25, 26, 28, 29 or 30 nucleotides in length and can comprise a sequence that has 70-75%, 75-80%, 80-85%, 85-90%, 90-95% or 95-100% homology with any one of the sequences set forth in SEQ ID NOS. 1-9999. Furthermore, it will be understood by the skilled artisan that the sequences set forth herein and in SEQ ID NOS. 1-9999 are 5'-3' sequences, and that the complementary 3'-5' set of consensus sequences are also contemplated as targets according to the methods disclosed herein.

The RpoN proteins as a class are divided into three regions (Wigneshweraraj, S. R., S, Nechaev, K. Severinov, and M. Buck. 2002. Beta subunit residues 186-433 and 436-445 are commonly used by Esigma54 and Esigma70 RNA polymerase for open promoter complex formation. J Mol Biol 319:1067-83). Region I located near the N-terminus interacts with the enhancer binding proteins (EBPs) necessary to activate transcription. Region II is a linking region. Region III contains subdomains that interact with the RNA polymerase and very highly conserved sequences that are involved in binding the −24/−12 binding (promoter) site on the DNA known as the RpoN box (Doucleff, M., J. G. Pelton, P. S. Lee, B. T. Nixon, and D. E. Wemmer. 2007. Structural basis of DNA recognition by the alternative sigma-factor, sigma54. J Mol Biol 369:1070-8). Because of the lack of homology in Region I among RpoN proteins from various bacterial species, it is likely that this region would be species specific for proper interactions with EBPs. Region II has even less homology cross species. On the other hand, Region III, with its high degree of conserved primary sequence, likely interacts with RpoN promoters regardless of species or primary sequence of Region I and Region II. It has been shown previously that overexpression of RpoN leads to growth inhibition in bacteria, but the cause of this is unknown (Sasse-Dwight, S., and J. D. Gralla. 1990. Role of eukaryotic-type functional domains found in the prokaryotic enhancer receptor factor sigma 54. Cell 62:945-54).

The present invention relates to a method for repressing transcription or gene expression from a binding site of interest, where the binding site of interest is an RpoN binding site or a cryptic promoter upstream or downstream of an RpoN binding site. The method involves the steps of: (a) providing an agent that (i) specifically and selectively binds to a sequence comprised in the binding site of interest and (ii) inhibits or represses expression of genes regulated by the binding site of interest; and (b) contacting the agent to the binding site of interest.

In one embodiment, the agent binds specifically to a −24, −12, or −24/−12 site for RpoN promoter interference.

In another embodiment, the RpoN binding site comprises a sequence selected from the group consisting of SEQ ID NOS. 1-9999 and the 3' to 5' complementary base pairs thereof.

In another embodiment, the agent comprises an amino acid sequence encoding a native or mutant RpoN protein.

In another embodiment, the agent is provided by heterologously expressing a native or mutant RpoN protein.

In another embodiment, the RpoN protein comprises a sequence selected from the group consisting of SEQ ID NOS. 10000-10093. In some embodiments, the RpoN protein consists (or consists essentially) of a sequence selected from the group consisting of SEQ ID NOS. 10000-10093.

In another embodiment, the agent comprises an amino acid sequence encoding a $\sigma^{54}$ ("sig54") protein.

In another embodiment, the agent is provided by heterologously expressing the $\sigma^{54}$ ("sig54") protein.

In another embodiment, the agent comprises an amino acid sequence encoding an RpoN protein comprising a modification to the heptad repeat overlapping the glutamine-rich or acid-rich motifs.

In another embodiment, the agent comprises an amino acid sequence encoding a stabilized cyclic peptide or fusion protein.

In another embodiment, the agent binds specifically and selectively to the cryptic promoter.

In another embodiment, the agent is a synthetic peptide from 20 to 600 amino acids in length.

In another embodiment, the synthetic peptide comprises at least 20 carboxy terminal amino acids of an RpoN protein.

In another embodiment, the synthetic peptide comprises the conserved amino acids from an RpoN box of Region III of an RpoN protein through the carboxy terminal amino acid residue of the RpoN protein.

In another embodiment, the synthetic peptide has 70-75%, 75-80%, 80-85%, 85-90%, 90-95% or 95-100% homology with an RpoN box of Region III of an RpoN protein.

In another embodiment, Region III comprises a modification of the heptad repeat overlapping the glutamine-rich or acid-rich motifs.

In another embodiment, bacterial cell motility is inhibited, bacterial cell growth is inhibited, bacterial quorum sensing is inhibited, bacteria are killed, bacterial attachment is inhibited, bacterial virulence is inhibited, bacterial wilt disease is prevented, or bacterial extra polysaccharide production is inhibited as a result of repression of transcription and/or gene expression from an RpoN binding site or a cryptic promoter upstream of an RpoN binding site by the agent within the bacterial cell.

In another embodiment, the inhibition of bacterial cell motility, the inhibition of bacterial cell growth, the inhibition of bacterial quorum sensing, the killing of bacteria, the inhibition of bacterial attachment, the inhibition of bacterial virulence, the prevention of bacterial wilt disease or the inhibition of bacterial extra polysaccharide production is temporally controlled through induction.

The present invention also relates to an agent for repressing transcription and/or gene expression from a binding site of interest, where the binding site of interest is an RpoN binding site or a cryptic promoter upstream of an RpoN binding site.

In one embodiment, the agent binds specifically to a −24, −12, or −24/−12 site(s) for RpoN promoter interference.

In another embodiment, the agent induces overexpression of a native or mutant RpoN protein.

In another embodiment, the agent comprises a $\sigma^{54}$ ("sig54") protein.

In another embodiment, the agent comprises a modification to the heptad repeat overlapping the glutamine-rich or acid-rich motifs of an RpoN protein.

In another embodiment, the agent comprises a stabilized cyclic peptide or fusion protein.

In another embodiment, the agent binds specifically and selectively to a cryptic promoter upstream of an RpoN binding site.

In another embodiment, the agent is a synthetic peptide from 20 to 600 amino acids in length.

In another embodiment, the synthetic peptide comprises at least 20 carboxy terminal amino acids of an RpoN protein.

In another embodiment, the synthetic peptide comprises the conserved amino acids from an RpoN box of Region III of an RpoN protein through the carboxy terminal amino acid residue of the RpoN protein.

In another embodiment, the synthetic peptide has 70-75%, 75-80%, 80-85%, 85-90%, 90-95% or 95-100% homology with an RpoN box of Region III of an RpoN protein.

In another embodiment, Region III comprises a modification of the heptad repeat overlapping the glutamine-rich or acid-rich motifs.

Also provided herein is a composition comprising an agent for repressing transcription and/or gene expression, bound to a binding site of interest, where the binding site of interest is an RpoN binding site or a cryptic promoter upstream of an RpoN binding site. In some embodiments, the composition further comprises a bacterial cell comprising the agent bound to the RpoN binding site or a cryptic promoter upstream of an RpoN binding site, wherein the agent is heterologous to the bacterial cell.

Also provided herein is a method for identifying an agent for repressing transcription or expression of a gene of interest from a promoter of interest, where the promoter of interest comprises an RpoN binding site or a cryptic promoter upstream of an RpoN binding site. The method comprises the steps of: (a) transforming an expression vector into a bacterial cell of interest, where the expression vector comprises a reporter gene operably linked to a promoter comprising an RpoN binding site or a cryptic promoter upstream of an RpoN binding site; and (b) determining the expression of the reporter gene in the absence and presence of a candidate agent, respectively. In some embodiments, the candidate agent is identified as an agent for repressing transcription or expression of a gene of interest from an RpoN binding site or a cryptic promoter upstream of an RpoN binding site when expression of the reporter gene is modulated in the presence of the candidate agent. In some embodiments, the identified agent decreases expression of the reporter gene. In some embodiments, the bacterial cell of interest does not comprise a native RpoN protein. In one embodiment, the promoter of interest is a sigma 70 (sig70, σ70) type promoter.

In another embodiment, the present invention provides a method for identifying an agent for repressing transcription or expression of a gene of interest from a promoter of interest, where the promoter of interest is an RpoN binding site or a cryptic promoter upstream of an RpoN binding site, the method comprising: (a) transforming a vector into a first wildtype strain and a first rpoN-deficient strain of a bacterial strain of interest, wherein the vector is an expression vector that expresses a candidate agent; and (b) transforming a vector into a second wildtype strain and a second rpoN-deficient strain of the bacterial strain of interest, wherein the vector is a parental empty vector of the expression vector of step (a). In some embodiments, the candidate agent comprises a candidate synthetic RpoN peptide.

This embodiment can further include the steps of: growing the first and second wildtype strains and the first and second rpoN-deficient strains (e.g., under identical conditions); isolating total RNA from the first and second wildtype strains and the first and second rpoN-deficient strains after the induction of expression of the candidate agent (e.g., a candidate synthetic RpoN binding protein (or peptide)); preparing cDNA libraries from mRNA isolated from total RNA from the first and second wildtype strains and the first and second rpoN deficient strains after the induction of expression of the candidate agent; using the cDNA libraries: in independent real-time sequencing experiments to identify the sequences of all total transcripts produced, thereby obtaining data concerning the identity of the transcripts, or to create labeled sequences to be used in microarray (gene chip) assays to evaluate expression of a transcriptome of the bacterial strain of interest, thereby obtaining data concerning the expression the transcriptome; analyzing the data obtained for similarities or differences in expression; comparing the first and second wildtype strains with the first and second rpoN-deficient strains to identify genes that are transcribed from previously cryptic promoters; and determining whether a transcriptome for an RpoN binding site or a cryptic promoter upstream of an RpoN binding site is present. In some embodiments, the candidate agent is identified as an agent for repressing transcription or expression of a gene of interest from an RpoN binding site or a cryptic promoter upstream of an RpoN binding site when a transcriptome is present.

The present invention also relates to a method for identifying an RpoN −24 conserved nucleotide sequence element for use in a screening assay, where the screening assay screens for an agent of interest that binds to the RpoN −24 conserved nucleotide sequence. This method involves the steps of: (a) transforming a bacterial cell with an expression vector comprising a reporter gene, where the vector comprises a −24 nucleotide sequence element comprising GTTG-GXXXXTT (where X is any nucleotide) positioned between a promoter and a ribosomal binding site (RBS) for the reporter gene; (b) contacting an RpoN protein or peptide to −24 element nucleotide sequence of the reporter gene construct; and (c) determining whether transcription mediated by the reporter gene promoter is impeded, thereby reducing expression of the reporter gene. In some embodiments, the −24 nucleotide sequence element comprising GTTG-GXXXXTT is identified as an RpoN −24 conserved nucleotide sequence element when expression of the reporter gene is reduced.

In one embodiment, the agent of interest is an RpoN protein, an RpoN synthetic peptide or a chemical compound.

In certain embodiments, the reporter gene promoter can be any suitable promoter known in the art including but not limited to lac, trc, T7, tac, $P_{BAD}$, $P_{GRAC}$, rrn promoter.

In another embodiment, the reporter gene encodes lacZ, gus, luciferase, green fluorescent protein (GFP), yellow fluorescent protein (YPF), blue fluorescent protein (BPF), mCherry or a derivative thereof.

The present invention further relates to a synthetic peptide comprising an amino acid sequence that: (a) has 70-75%, 75-80%, 80-85%, 85-90%, 90-95% or 95-100% homology with an RpoN box of Region III of an RpoN protein; and (b) binds specifically to a −24, −12, or −24/−12 site(s) of an RpoN promoter, where the synthetic peptide is effective for repressing transcription and/or gene expression from a binding site of interest, and where the binding site of interest is an RpoN binding site or a cryptic promoter upstream of an RpoN binding site.

In one embodiment, the amino acid sequence comprises the conserved amino acids from an RpoN box of Region III of an RpoN protein through the carboxy terminal amino acid residue of the RpoN protein.

In another embodiment, the Region III comprises a modification to the heptad repeat overlapping the glutamine-rich or acid-rich motifs of an RpoN protein.

In another embodiment, the amino acid sequence comprises at least 20 carboxy terminal amino acids of an RpoN protein.

In another embodiment, the amino acid sequence binds specifically and selectively to a cryptic promoter upstream of an RpoN binding site.

In another embodiment, the amino acid sequence comprises SEQ ID NO:10103 or a functional variant thereof.

The present invention also relates to an isolated nucleic acid molecule encoding the synthetic peptide of the present invention.

In another embodiment, the nucleic acid molecule comprises the nucleotide sequence of SEQ ID NO:10102.

The present invention also relates to a vector comprising the isolated nucleic acid molecule encoding the synthetic peptide of the present invention.

The present invention also relates to a host cell comprising the vector of the present invention.

The present invention further relates to a method of using the synthetic peptide of the present invention for repressing transcription or gene expression from a binding site of interest, where the binding site of interest is an RpoN binding site or a cryptic promoter upstream or downstream of an RpoN binding site. The method involves the steps of: (a) providing the synthetic peptide according to the present invention; and (b) contacting the synthetic peptide to the binding site of interest, thereby repressing transcription or gene expression from the binding site of interest.

Further disclosure regarding aspects of the present invention is provided below.

Method for Repressing Transcription and/or Gene Expression:

A method is provided for repressing transcription and/or gene expression from RpoN binding sites or cryptic promoters upstream of RpoN binding sites. The method can be used to simultaneously shut down the many metabolic pathways that bacteria need to grow and to maintain their virulence. The method can be used as a master switch to turn off the growth of bacteria. The method targets the RpoN binding site, which is conserved among a wide range of bacteria. Thus, inhibition or blocking of the RpoN binding site is deleterious or fatal to the bacteria, and because the binding site regulates so many genes and its sequence is so well conserved, bacteria cannot easily evolve or mutate around the targeted RpoN binding site.

The method can be used, for example to inhibit bacterial cell motility, inhibit bacterial cell growth, inhibit bacterial quorum sensing, kill bacteria, inhibit bacterial attachment, inhibit bacterial virulence, prevent bacterial wilt disease, and/or inhibit bacterial extra polysaccharide production. In another embodiment, any of these uses of the method can be temporally controlled through induction, using standard methods known in the art.

The method comprises providing an agent that specifically and selectively binds to RpoN binding site sequences (or cryptic promoters upstream of RpoN binding sites) to inhibit or repress the expression of genes downstream of that promoter; and contacting the RpoN binding site with the agent.

In one embodiment, the agent can compete with the native RpoN protein for binding at the RpoN binding site. In another embodiment, the agent can bind to a site upstream or downstream of the RpoN binding site and physically block transcription. In another embodiment, the agent blocks the interaction between a transcriptional activator and a RNA polymerase holoenzyme. The agent can bind, for example, at a site between the activator binding site and the binding site for RNA polymerase holoenzyme at a separate promoter.

The agent can be any composition known in the art that will bind specifically to the −24, −12, or −24/−12 site(s) for RpoN binding site (or promoter) interference. Delivery of the agent to the target can include but are not limited to delivery via bacteriophage (Beumer, A., and J. B. Robinson. 2005. A broad-host-range, generalized transducing phage (SN-T) acquires 16S rRNA genes from different genera of bacteria. Appl Environ Microbiol 71:8301-8304; Kwan, T., J. Liu, M. Dubow, P. Gros, and J. Pelletier. 2006. Comparative genomic analysis of 18 *Pseudomonas aeruginosa* bacteriophages. J Bacteriol 188:1184-7; Liu, J., M. Dehbi, G. Moeck, F. Arhin, P. Bauda, D. Bergeron, M. Callejo, V. Ferretti, N. Ha, T. Kwan, J. McCarty, R. Srikumar, D. Williams, J. J. Wu, P. Gros, J. Pelletier, and M. DuBow. 2004. Antimicrobial drug discovery through bacteriophage genomics. Nat Biotechnol 22:185-91), plasmid, chromosomal insertion, RNA, single stranded DNA, single stranded RNA, double stranded DNA, double stranded DNA, DNA-RNA hybrids, which could be linear, circular, or supercoiled. These can enter the cell via delivery methods well known in the art, e.g., transformation, electroporation (Wang, Q., A. P. Mueller, C. R. Leong, K. Matsumoto, S. Taguchi, and C. T. Nomura. 2010. Quick and efficient method for genetic transformation of biopolymer-producing bacteria. J Chem Technol Biotechnol 85:775-778), using a carrier such as DMSO diffusion (Pottz, G., J. Rampey, and B. Furmandean. 1967. The effect of dimethyl sulfoxide (DMSO) on antibiotic sensitivity of a group of medically important microorganisms: preliminary report. Ann NY Acad Sci 141:261-272) via fusion with a carrier such as a siderophore (Budzikiewicz, H.2001. Siderophore-antibiotic conjugates used as Trojan horses against *Pseudomonas aeruginosa*. Curr Top Med Chem 1:73-82), etc.

Three embodiments of the method for inhibiting or repressing the expression of genes downstream from an RpoN promoter are shown in FIGS. 3A-C.

In one embodiment (FIG. 3A), an agent, e.g., a non-native, mutant protein, synthetic peptide, or chemical compound, is used. The agent is capable of binding to the RpoN binding sequence (indicated by the hexagon $\sigma^{54*}$) and antagonizes transcription by the RNA polymerase. Once bound, the agent, e.g., a non-native, mutant protein, a synthetic peptide, or a chemical compound, is unable to interact with the RNA polymerase or activator proteins, thus preventing transcription of the RpoN-specific locus.

In another embodiment (FIG. 3B), multiple copies of a sigma factor, e.g., the sigma factor $\sigma^{54}$, above the level of the native sigma factor can be used to titer out the RpoN promoter sites and to thereby repress the transcription of all loci regulated by RpoN. In FIG. 3B, multiple copies of the native RpoN protein are expressed from the plasmid, showing an inhibitory effect on motility. In cases where genes or operons have more than one promoter, the $\sigma^{54*}$ can inhibit expression by physically blocking RNA polymerase holoenzyme associated with another sigma factor (FIG. 3C). In the embodiment depicted in FIG. 3C, $\sigma^{54*}$, a $\sigma^{70}$ type sigma factor is used, but any sigma factor known in the art may be used that promotes transcription from upstream of the molecular roadblock.

In another embodiment, the agent is an exogenous RpoN protein with a low degree of homology with the native RpoN protein of the bacterial strain that is being treated wherein the exogenous RpoN protein is capable of binding to an RpoN binding site (or promoter) to prevent the expression of one or more genes under the control of RpoN. According to this embodiment, an overabundance of the agent that binds the RpoN promoter can be used. In another embodiment, the agent can be a heterologous RpoN from another bacterial species with low sequence homology to the RpoN protein of the bacteria being treated. Alternatively, engineered RpoN proteins incapable of interacting with the RNA polymerase or enhancer binding proteins (EBPs) can be used. This will result in repression of all RpoN-promoters in the cell.

Exemplary RpoN proteins that can be used according to the methods of the invention are set forth as SEQ ID NOS. 10000-10093.

According to the methods of the invention, any known loci that encode proteins that are regulated by RpoN will be repressed. Additionally, unknown loci that may be under the control of multiple promoters will be repressed. Multiple pathways can be repressed at the same time.

Agents for Repressing RpoN Binding Sites or Cryptic Promoters Upstream of RpoN Binding Sites The method provided herein comprises the step of providing an agent that specifically and selectively binds to an RpoN binding site or promoter sequence (or to a cryptic promoter upstream of an RpoN binding site) to inhibit or repress the expression of genes downstream of that binding site; and contacting the RpoN binding site with the agent. Agents that specifically and selectively bind to an RpoN binding site sequence (or to a cryptic promoter upstream of an RpoN binding site) are also provided.

As disclosed herein, the agent specifically and selectively binds to RpoN promoter sequences to inhibit or repress the expression of genes downstream of that promoter. The agent can be any composition known in the art that will bind specifically to the −24, −12, or −24/−12 site(s) for RpoN promoter interference, e.g., a wild-type or native protein, a non-native protein, a mutant protein, a synthetic peptide, or a chemical compound. Any chemical compound known in the art that binds specifically to the RpoN promoter sequence can be used. In one embodiment, the agent can be a non-protein compound capable of specifically binding to the RpoN promoter site. (e.g., comprising one or more mutations to a native amino acid sequence).

In other embodiments, the agent can be any RpoN protein known in the art, e.g., a wild-type, native, non-native, naturally occurring mutant, engineered (e.g., comprising one or more mutations to a native amino acid sequence) or recombinant RpoN protein.

In another embodiment, the agent can be a wild-type, native, non-native, naturally occurring mutant, engineered or recombinant RpoN protein of interest (or a purified derivative or analog thereof) that displays one or more functional activities of an RpoN protein and that shares at least 30% homology with the RpoN protein of interest. In other embodiments, the agent can be a wild-type, native, non-native, naturally occurring mutant, engineered or recombinant RpoN protein of interest (or a purified derivative or analog thereof) that shares 30-40%, 40-50%, 50-60%, 60-70%, 70-80%, 80-90% or 90-100% homology with the RpoN protein of interest.

In other embodiments, the agent can be a wild-type, native, non-native, naturally occurring mutant, engineered or recombinant RpoN protein of interest (or a purified derivative or analog thereof) that shares 30% or more homology for Region III. In yet other embodiments, the agent can share 30-40%, 40-50%, 50-60%, 60-70%, 70-80%, 80-90% or 90-100% homology with Region III.

Compounds of the aureolic acid family such as mithramycin (MTM), chromomycin, and their derivatives capable of binding to GC-rich DNA sequences that have been used as anticancer drugs are examples of such chemical compounds (Albertini, V., A. Jain, S. Vignati, S, Napoli, A. Rinaldi, I. Kwee, M. Nur-e-Alam, J. Bergant, F. Bertoni, G. M. Carbone, J. Rohr, and C. V. Catapano. 2006. Novel GC-rich DNA-binding compound produced by a genetically engineered mutant of the mithramycin producer *Streptomyces* argillaceus exhibits improved transcriptional; Pucci, D., V. Albertini, R. Bloise, A. Bellusci, A. Cataldi, C. V. Catapano, M. Ghedini, and A. Crispini. 2006. Synthesis and anticancer activity of cyclopalladated complexes containing 4-hydroxy-acridine. J Inorg Biochem 100:1575-8).

In one embodiment, a $\sigma^{54}$ protein is used as the agent. Any $\sigma^{54}$ protein known in the art can be used, e.g., *Klebsiella pneumoniae* $\sigma^{54}$ protein: I123N, L200P, Q351R, S379F, S404F (Pitt, M., M. T. Gallegos, and M. Buck. 2000. Single amino acid substitution mutants of *Klebsiella pneumoniae* sigma(54) defective in transcription. Nucleic Acids Res 28:4419-27).

Other proteins that can be used as agents include, but are not limited to, a modification to the heptad repeat overlapping the glutamine-rich or acid-rich motifs as disclosed in Sasse-Dwight, S., and J. D. Gralla (1990. Role of eukaryotic-type functional domains found in the prokaryotic enhancer receptor factor sigma 54. Cell 62:945-54), truncated RpoN proteins as disclosed in Wong, C., Y. Tintut, and J. D. Gralla (1994. The domain structure of sigma 54 as determined by analysis of a set of deletion mutants. J Mol Biol 236:81-90), including but not limited to Δ2-16, Δ18-31, Δ51-56, Δ79-131, Δ133-157, Δ178-183, Δ4213-244, Δ246-291, Δ293-332 of the RpoN protein from *Escherichia coli*, and truncated RpoN protein from *Aquifex aeolicus* (residues 338-398) as disclosed in Doucleff, M., J. G. Pelton, P. S. Lee, B. T. Nixon, and D. E. Wemmer (2007. Structural basis of DNA recognition by the alternative sigma-factor, sigma54. J Mol Biol 369:1070-8).

In another embodiment, the agent is an RpoN protein with a low degree of homology with the RpoN protein of the bacterial strain that is being treated and/or a peptide that is capable of binding to RpoN promoters to prevent the expression of genes under the control of RpoN. An agent can also be a heterologous RpoN from another bacterial species with low sequence homology to the RpoN protein of the bacteria being treated. Alternatively, engineered RpoN proteins incapable of interacting with the RNA polymerase or enhancer binding proteins (EBPs) can be used as an agent. This will result in repression of all RpoN-promoters in the cell.

In a specific embodiment, the agent is a stabilized cyclic peptide or a stabilized fusion protein, e.g., art-known stabilized cyclic peptides or fusion proteins such as maltose binding protein, glutathione, and green fluorescent protein. An exemplary fusion protein is shown in FIG. 4 (RpoN-thioredoxin fusion).

Overexpression of a protein agent may result in aggregation and poor solubility in heterologous systems. As few as 22.7% of proteins expressed in *E. coli* have been soluble (Butt, T., S. Edavettal, J. Hall, and M. Mattern. 2005. SUMO fusion technology for difficult-to-express proteins. Protein Exp Pur 43:1-9). A variety of structures have been used to enhance soluble protein expression. Some structures that can be added to help with solubility of the protein and stabilization include: small ubiquitin modifying protein (SUMO), glutathione S-transferase (GST), maltose binding protein (MBP), thioredoxin (trx), ubiquitin (Ub), DsbA, NusA, bacterioferritin (BFR), and GrpE (Butt, T., S. Edavettal, J. Hall, and M. Mattern. 2005. SUMO fusion technology for difficult-to-express proteins. Protein Exp Pur 43:1-9; Davis, G., C. Elisee, D. Newham, and R. Harrison. 1999. New fusion protein systems designed to give soluble expression in *Escherichia coli*. Biotechnol Bioeng 65:382-388).

Binding of the agent to an RpoN binding site (or promoter) can be determined or screened for using methods known in the art such as: electrophoretic mobility shift assays (Wigneshweraraj, S. R., S, Nechaev, K. Severinov, and M. Buck. 2002. Beta subunit residues 186-433 and 436-445 are commonly used by Esigma54 and Esigma70 RNA polymerase for open promoter complex formation. J Mol Biol 319:1067-83), transcriptomic analyses using either microarrays or real time sequencing, or reporter assays as described in Example 2.

Any known reporter gene known in the art can be used to screen for binding of an agent to an RpoN binding site, e.g., lacZ; luciferase; gus; green fluorescent protein (GFP), yellow fluorescent protein (YPF), blue fluorescent protein (BPF), mCherry or a derivative thereof. A putative agent can be contacted to an RpoN binding site and modulation (e.g., lowered expression) of the reporter can be screened for.

In another embodiment, the agent specifically and selectively binds to RpoN binding sites downstream of a cryptic promoter thus inhibiting expression from that cryptic promoter. This is demonstrated in Example 4 (see Tables 5-8, in which exemplary sequences of the binding sites are set forth).

The RpoN promoter sequences set forth as SEQ ID NOS 1-9999 are also exemplary RpoN promoter sequences can be used according to the methods of the invention.

A screen is also provided herein to assay the binding of compounds to an RpoN nucleotide sequence. See Example 2 for one embodiment of the screen, an assay for the binding of compounds to the RpoN −24 conserved nucleotide sequence.
Uses of the Method:

The method provided herein can be used in many different applications. The method specifically interferes with the expression of genes involved in bacterial pathogenesis, motility, communication, growth and biofilm production. An advantage of the method is that it can interfere with all of these bacterial characteristics simultaneously, and thus can have broad applications related to medical and preventative treatments for bacterial infection, biocontrol of bacteria or biofouling by bacteria. Since multiple pathways can be repressed at the same time, the method can also be used, for example, to define RpoN regulons for biomedical research and development.

In addition, the method can be used as a tool to study antagonistic relationships of the native RpoN transcription factor under a variety of conditions and in a temporal manner, thereby allowing for fine-tuned analysis of when the RpoN transcription factor is necessary for bacterial responses to the environment. This has the added benefit of identifying regulatory circuits to target with traditional antibiotics.

Because of the ubiquitous and conserved nature of the RpoN promoter, the method targets a broad range of bacteria, including, but not limited to *Pseudomonas aeruginosa, Pseudomonas syringae, Pseudomonas putida, Helicobacter pylori, Campylobacter jejuni, Bacillus subtilis, Bacillus anthracis, Mycobacterium tuberculosis, Escherichia coli, Salmonella typhimurium, Salmonella enterica, Legionella pneumophila, Listeria monocytogenes, Methylobacterium extorquens, Myxococcus xanthus, Borrelia burgdorferi, Vibrio cholerae, Acinetobacter baumanii, Agrobacterium tumefaciens, Bacillus cereus, Bacteroides fragilis, Candidatus* spp., *Chlamydia trachomatis, Chlamydophila pneumoniae, Clostridium acetobutylicum, Clostridium kluyberi, Clostridium perfringens, Geobacter sulfurreducens, Gramella forsetii, Neisseria meningitidis, Ralstonia solanacearum, Shewanella oneidensis, Soilbacter usitatus, Sorangium cellulosum, Sphaerobacter thermophilus, Staphylococcus aureus, Sulfurihydrogenibium* sp. YO3AOP1, *Treponema denticola*, and *Yersinia pestis*. The RpoN promoter sequence and RpoN regulate bacterial expression of genes but not eukaryotic expression of genes. Thus, the technology can be used in humans and animals. The method provides a simple way to inhibit pathogenesis because the expression levels of many of the proteins for virulence in pathogenic bacteria are regulated by RpoN.

The method can be used in medical, agricultural, and bioprocess industries.

Many of the genes encoding proteins associated with biofilm synthesis are regulated by RpoN promoters. Biofilms can be persistent and a source of biofouling of water sources, coatings, microbial influenced corrosion (rusting). The method provided herein can address this by repressing expression of genes associated with the building of these sticky films across a broad spectrum of bacteria.

The method can be used to discover cryptic promoters and genes regulated by RpoN. By using the method to inhibit expression of genes regulated by RpoN promoters, genes can be identified via comparisons using art-known transcriptome analyzing technologies (e.g., real time sequencing, quantitative real time PCR (QRT PCR), microarray analysis).

The method can be used to improve bioprocess applications such as protein and bioproduct production by decreasing metabolic burden of RpoN expressed genes in cells. By eliminating unnecessary burden from RpoN expressed genes, more energy can go towards bioproduct production.

EXAMPLES

The following examples are intended to illustrate particular embodiments of the present invention, but are by no means intended to limit the scope of the present invention.

Example 1

Use of a Synthetic RpoN Promoter Binding Protein in Bacteria to Inhibit the Expression of Virulence Factors This example demonstrates one embodiment of the method for repressing transcription and/or gene expression from an RpoN promoter. In the example, a synthetic RpoN promoter binding protein is used in bacteria to inhibit the expression of virulence factors.

Introduction

Pseudomonads are a broad group of Gram-negative bacteria that are found in many environmental niches. Despites some similarities in gene organization among pseudomonads, some pseudomonads are pathogenic to plants (Penaloza-Vazquez, A., M. K. Fakhr, A. M. Bailey, and C. L. Bender. 2004. AlgR functions in algC expression and virulence in *Pseudomonas syringae* pv. *syringae*. Microbiology 150:2727-37) or animals (Hendrickson, E. L., J. Plotnikova, S. Mahajan-Miklos, L. G. Rahme, and F. M. Ausubel. 2001.

Differential roles of the *Pseudomonas aeruginosa* PA14 rpoN gene in pathogenicity in plants, nematodes, insects, and mice. J Bacteriol 183:7126-34).

*Pseudomonas aeruginosa* is a Gram-negative opportunistic pathogen that causes nosocomial infections and has been implicated as one of the top five organisms that cause pulmonary, bloodstream, urinary tract, surgical site, and soft tissue infections (Veesenmeyer, J. L., A. R. Hauser, T. Lisboa, and J. Rello. 2009. *Pseudomonas aeruginosa* virulence and therapy: evolving translational strategies. Crit. Care Med 37:1777-86). *P. aeruginosa* is also the leading cause of death among patients with cystic fibrosis (Gilligan, P. H. 1991. Microbiology of airway disease in patients with cystic fibrosis. Clin Microbiol Rev 4:35-51). There are many factors associated with virulence that are produced during the course of infection by *P. aeruginosa* including exotoxin A (Azghani, A. O. 1996. *Pseudomonas aeruginosa* and epithelial permeability: role of virulence factors elastase and exotoxin A. Am Respir Cell Mol Biol 15:132-40), hemolysin (Rampioni, G., M. Schuster, E. P. Greenberg, E. Zennaro, and L. Leoni. 2009. Contribution of the RsaL global regulator to *Pseudomonas aeruginosa* virulence and biofilm formation. FEMS Microbiol Lett 301:210-7), elastase (Azghani, A. O. 1996. *Pseudomonas aeruginosa* and epithelial permeability: role of virulence factors elastase and exotoxin A. Am J Respir Cell Mol Biol 15:132-40; Park, P. W., G. B. Pier, M. T. Hinkes, and M. Bernfield. 2001. Exploitation of syndecan-1 shedding by *Pseudomonas aeruginosa* enhances virulence. Nature 411: 98-102), alginate (Cabral, D. A., B. A. Loh, and D. P. Speert. 1987. Mucoid *Pseudomonas aeruginosa* resists nonopsonic phagocytosis by human neutrophils and macrophages. Pediatr Res 22:429-3; Simpson, J. A., S. E. Smith, and R. T. Dean. 1989. Scavenging by alginate of free radicals released by macrophages. Free Radic Biol Med 6:347-53), flagella (Balloy, V., A. Verma, S. Kuravi, M. Si-Tahar, M. Chignard, and R. Ramphal. 2007. The role of flagellin versus motility in acute lung disease caused by *Pseudomonas aeruginosa*. J Infect Dis 196:289-96; Feldman, M., R. Bryan, S. Rajan, L. Scheffler, S. Brunnert, H. Tang, and A. Prince. 1998. Role of flagella in pathogenesis of *Pseudomonas aeruginosa* pulmonary infection. Infect Immun 66:43-5), pili (Chi, E., T. Mehl, D. Nunn, and S. Lory. 1991. Interaction of *Pseudomonas aeruginosa* with A549 pneumocyte cells. Infect Immun 59:822-8; Tang, H., M. Kays, and A. Prince. 1995. Role of *Pseudomonas aeruginosa* pili in acute pulmonary infection. Infect Immun 63:1278-85), extracellular proteases (Nicas, T. I., and B. H. Iglewski. 1985. The contribution of exoproducts to virulence of *Pseudomonas aeruginosa*. Can J Microbiol 31:387-92), rhamnolipids, lipopolysaccharide (Danner, R. L., C. Natanson, R. J. Elfin, J. M. Hosseini, S. Banks, T. J. MacVittie, and J. E. Parrillo. 1990. *Pseudomonas aeruginosa* compared with *Escherichia coli* produces less endotoxemia but more cardiovascular dysfunction and mortality in a canine model of septic shock. Chest 98:1480-7; Pier, G. B., and P. Ames. 1984. Mediation of the killing of rough, mucoid isolates of *Pseudomonas aeruginosa* from patients with cystic fibrosis by the alternative pathway of complement. J Infect Dis 150: 223-8), quorum sensing (Pearson, J. P., M. Feldman, B. H. Iglewski, and A. Prince. 2000. *Pseudomonas aeruginosa* cell-to-cell signaling is required for virulence in a model of acute pulmonary infection. Infect Immun 68:4331-4; Rampioni, G., M. Schuster, E. P. Greenberg, E. Zennaro, and L. Leoni. 2009. Contribution of the RsaL global regulator to *Pseudomonas aeruginosa* virulence and biofilm formation. FEMS Microbiol Lett 301:210-7), pyocyanin (Rampioni, G., M. Schuster, E. P. Greenberg, E. Zennaro, and L. Leoni. 2009. Contribution of the RsaL global regulator to *Pseudomonas aeruginosa* virulence and biofilm formation. FEMS Microbiol Lett 301:210-7), cyanide (Reimmann, C., M. Beyeler, A. Latifi, H. Winteler, M. Foglino, A. Lazdunski, and D. Haas. 1997. The global activator GacA of *Pseudomonas aeruginosa* PAO positively controls the production of the autoinducer N-butyryl-homoserine lactone and the formation of the virulence factors pyocyanin, cyanide, and lipase. Mol Microbiol 24:309-19), pyoverdines (Imperi, F., F. Tiburzi, and P. Visca. 2009. Molecular basis of pyoverdine siderophore recycling in *Pseudomonas aeruginosa*. Proc Natl Acad Sci USA 106:20440-5), biofilms (Jesaitis, A. J., M. J. Franklin, D. Berglund, M. Sasaki, C. I. Lord, J. B. Bleazard, J. E. Duffy, H. Beyenal, and Z. Lewandowski. 2003. Compromised host defense on *Pseudomonas aeruginosa* biofilms: characterization of neutrophil and biofilm interactions. J Immunol 171: 4329-39), and type III secretion system (Lee, V. T., R. S. Smith, B. Tummler, and S. Lory. 2005. Activities of *Pseudomonas aeruginosa* effectors secreted by the Type III secretion system in vitro and during infection. Infect Immun 73:1695-705; Vance, R. E., A. Rietsch, and J. J. Mekalanos. 2005. Role of the type III secreted exoenzymes S, T, and Y in systemic spread of *Pseudomonas aeruginosa* PAO1 in vivo. Infect Immun 73:1706-13). Current therapeutics independently target many of the virulence factors of *P. aeruginosa* (Veesenmeyer, J. L., A. R. Hauser, T. Lisboa, and J. Rello. 2009. *Pseudomonas aeruginosa* virulence and therapy: evolving translational strategies. Crit. Care Med 37:1777-86), but no single current therapy addresses all of these factors.

The expression of the genes encoding these factors or proteins, which make these factors, is controlled by essential subunits of the prokaryotic RNA polymerase called sigma factors. Sigma factors fall into two structurally and mechanistically distinct families: sig70-like sigma factors and sig54. Both families of sigma factors bind to the core RNA polymerase but activate transcription in very different ways. Sig70 class sigma factors bind to the core RNA polymerase holoenzyme (Murakami, K. S., S. Masuda, E. A. Campbell, O. Muzzin, and S. A. Darst. 2002. Structural basis of transcription initiation: An RNA polymerase holoenzyme-DNA complex. Science 296:1285-1290) and then to a promoter specific DNA sequence (usually −10 and −35 nt upstream of the transcription start site) to initiate transcription. Sig54 class sigma factors bind to a conserved nucleotide sequence (mrNrYTGGCACG-N4-TTGCWNNw), the RpoN ($\sigma^{54}$) promoter or binding site (Barrios, H., B. Valderrama, and E. Morett. 1999. Compilation and analysis of sigma(54)-dependent promoter sequences. Nucleic Acids Res 27:4305-13). The sequence is remarkably conserved with some nucleotides in the −24 and −12 sites>90% conserved across a number of bacterial species (Barrios, H., B. Valderrama, and E. Morett. 1999. Compilation and analysis of sigma(54)-dependent promoter sequences. Nucleic Acids Res 27:4305-13).

However, unlike the sig70 family of sigma factors, sig54 is capable of binding to this DNA sequence without first interacting with the RNA polymerase. Once the sig54 interacts with the core RNA polymerase it forms a transcriptionally inactive closed complex consisting of the holoenzyme bound to DNA (Buck, M., M. T. Gallegos, D. J. Studholme, Y. Guo, and J. D. Gralla. 2000. The bacterial enhancer-dependent sigma(54) (sigma(N)) transcription factor. J Bacteriol 182: 4129-36). Unlike sig70 RNA polymerase holoenzymes, the sig54-RNA polymerase complex cannot spontaneously isomerize from a closed to open transcription complex. It must further interact with other transcriptional activating proteins called enhancer binding proteins (EBPs) and use the energy of nucleotide hydrolysis in order to activate transcription from the RpoN promoter (Chen, B., M. Doucleff, D. E. Wemmer, S. De Carlo, H. H. Huang, E. Nogales, T. R. Hoover, E. Kondrashkina, L. Guo, and B. T. Nixon. 2007. ATP ground- and transition states of bacterial enhancer binding AAA+ATPases support complex formation with their target protein, sigma54. Structure 15:429-40).

The RpoN proteins as a class are divided into three regions (Wigneshweraraj, S. R., S, Nechaev, K. Severinov, and M. Buck. 2002. Beta subunit residues 186-433 and 436-445 are commonly used by Esigma54 and Esigma70 RNA polymerase for open promoter complex formation. J Mol Biol 319:1067-83). Region I located near the N-terminus interacts with EBPs necessary to activate transcription. Region II is a linking region. Region III contains subdomains that interact with the RNA polymerase and very highly conserved sequences that are involved in binding the −24/−12 promoter site on the DNA known as the RpoN domain (Doucleff, M., J. G. Pelton, P. S. Lee, B. T. Nixon, and D. E. Wemmer. 2007. Structural basis of DNA recognition by the alternative sigma-factor, sigma54. J Mol Biol 369:1070-8). Because of the lack of homology in Region I among RpoN proteins from various bacterial species, it is likely that this region would be species specific for proper interactions with EBPs. Region II has even less homology cross species. On the other hand, Region III, with its high degree of conserved primary sequence, likely interacts with RpoN promoters regardless of species or primary sequence of Region I and Region II. It has been shown previously that overexpression of RpoN leads to growth inhibition in bacteria, but the cause of this is unknown (Sasse-Dwight, S., and J. D. Gralla. 1990. Role of eukaryotic-type functional domains found in the prokaryotic enhancer receptor factor sigma 54. Cell 62:945-54). The RpoN protein has been shown to activate transcription of genes encoding proteins involved in nitrogen utilization, pilin, flagella, and virulence-related factors in P. aeruginosa (Hendrickson, E. L., J. Plotnikova, S. Mahajan-Miklos, L. G. Rahme, and F. M. Ausubel. 2001. Differential roles of the Pseudomonas aeruginosa PA14 rpoN gene in pathogenicity in plants, nematodes, insects, and mice. J Bacteriol 183:7126-34; Thompson, L. S., J. S. Webb, S. A. Rice, and S. Kjelleberg. 2003. The alternative sigma factor RpoN regulates the quorum sensing gene rhlI in Pseudomonas aeruginosa. FEMS Microbiol Lett 220:187-95; Totten, P. A., J. C. Lara, and S. Lory. 1990. The rpoN gene product of Pseudomonas aeruginosa is required for expression of diverse genes, including the flagellin gene. J Bacteriol 172:389-96). These virulence factors are also under control of RpoN promoters in other bacteria as well (Cases, I., D. W. Ussery, and V. de Lorenzo. 2003. The sigma54 regulon (sigmulon) of Pseudomonas putida. Environ Microbiol 5:1281-93; Hendrickson, E. L., J. Plotnikova, S. Mahajan-Miklos, L. G. Rahme, and F. M. Ausubel. 2001. Differential roles of the Pseudomonas aeruginosa PA14 rpoN gene in pathogenicity in plants, nematodes, insects, and mice. J Bacteriol 183:7126-34; Studholme, D. J., and M. Buck. 2000. The biology of enhancer-dependent transcriptional regulation in bacteria: insights from genome sequences. FEMS Microbiol Lett 186:1-9).

The unique nature with which the RpoN protein regulates gene expression presents a great target for simultaneous inhibition of the expression of virulence factors. This example demonstrates that a synthetic peptide comprising amino acids from Region III of the RpoN protein (see Table 3) can antagonistically impair transcription from multiple RpoN promoters in P. aeruginosa. These amino acids can be defined by the 60 amino acid region of the carboxy terminus of the RpoN protein. Key residues are defined by the RpoN box. Specific residues within the RpoN box essential for interaction include the following sequence of amino acids: ARRTVAKYR(E/D). A thorough definition is given by Doucleff, M., J. G. Pelton, P. S. Lee, B. T. Nixon, and D. E. Wemmer (2007. Structural basis of DNA recognition by the alternative sigma-factor, sigma54. J Mol Biol 369:1070-8). By expressing a peptide capable of binding to the RpoN binding site that is incapable of interacting with the core RNA polymerase or the EBPs, transcription of genes regulated by native RpoN can be disrupted. The antagonistic action of this peptide renders the strain incapable of producing a number of virulence factors and provides information on the multi-layered transcriptional regulation provided by RpoN.

Materials and Methods

Bacterial Strains, Plasmids, and Growth Conditions

Table 1 lists the bacterial strains and plasmids used in the experiments described in this example. *Escherichia coli* strains were routinely grown on Difco™ LB broth (per liter: 10 g tryptone, 5 g yeast extract, 5 g NaCl) nutrient yeast broth (NYB, per liter: 25 g nutrient broth Oxoid no. 2, 5 g yeast extract), or M63 minimal media (per liter: 3 g $KH_2PO_4$, 7 g $K_2HPO_4$, 2 g $(NH_4)_2SO_4$, 0.25 g $MgSO_4.7H_2O$, 5 g glucose, pH 7.0). The following antibiotics were used for *E. coli*: ampicillin, 100 μg ml$^{-1}$, kanamycin 50 μg ml$^{-1}$, tetracycline 10 μg ml$^{-1}$, gentamicin 10 μg ml$^{-1}$, for *P. putida*: kanamycin 50 μg ml$^{-1}$, gentamicin 50 μg ml$^{-1}$, for *P. aeruginosa*: gentamicin 50 μg ml$^{-1}$, for *R. solanacearum*: kanamycin 50 μg ml$^{-1}$, and for *B. cepacia*: gentamicin 50 μg ml$^{-1}$. Isopropyl β-thiogalactopyranoside (IPTG) was purchased from Fisher chemicals. Polymerase Chain Reaction (PCR) was done using the DNA polymerase PrimeStar™ (Takara Biosciences) according to the manufacturer's instructions. All endonucleases and DNA modifying enzymes were purchased from New England Biolabs (Ipswich, Mass.). All nucleic acids were purified using Promega (Madison, Wis.) DNA purification systems.

TABLE 1

Strains and plasmids used in this example.

| Construct | Description | Reference or source |
|---|---|---|
| *Pseudomonas putida* | | |
| KT2440 | Wild-type | ATCC |
| rpoN | rpoN::Km$^r$ | Kohler, T., S. Harayama, J. L. Ramos, and K. N. Timmis. 1989. Involvement of *Pseudomonas putida* RpoN sigma factor in regulation of various metabolic functions. J Bacteriol 171: 4326-33 |
| | KT2440 derivative, pBBR1MCS-2 | This example |
| | rpoN derivative, pBBR1MCS-2 | This example |
| | KT2440 derivative, pBRL340 | This example |
| | rpoN derivative, pBRL340 | This example |

TABLE 1-continued

Strains and plasmids used in this example.

| Construct | Description | Reference or source |
|---|---|---|
| *Pseudomonas aeruginosa* | | |
| PAO1 | Wild-type | ATCC |
| PAO6359 | rpoN::Ω-Km | Heurlier, K., V. Denervaud, G. Pessi, C. Reimmann, and D. Haas. 2003. Negaitive control of quorum sensing by RpoN (sig54) in *Pseudomonas aeruginosa* PAO1. J Bacteriol 185: 2227-2235 |
| PAO1/pBRL344 | PAO1 derivative, pBRL344 | This example |
| PAO1/pBRL348 | PAO1 derivative, pBRL348 | This example |
| PAO1/pBRL349 | PAO1 derivative, pBRL349 | This example |
| PAO6359/pBRL344 | PAO6359 derivative, pBRL344 | This example |
| PAO6359/pBRL348 | PAO6359 derivative, pBRL348 | This example |
| PAO6359/pBRL349 | PAO6359 derivative, pBRL349 | This example |
| *Burkholderia cepacia* ATCC 17759 | Wild-type | ATCC |
| *Ralstonia solanacearum* AW-1 | Wild-type | Denny, T. P., F. W. Makini, and S. W. Brumbley. 1988. Genetic evidence that extracellular polysaccharide is a virulence factor of *Pseudomonas solanacearum* Tn5 mutants deficient in extracellular polysaccharide. Mol Plant-Microbe Interact 1: 215-223 |
| *Escherichia coli* | | |
| JM109 | recA1 endA1 gyrA96 thi-1 hsdR17 ($r_K^-$ $m_K^+$) supE44 relA1 λ-lac [F' proAB lacI$^q$ ZΔM15] | Promega |
| TOP10 | F-mcrA Δ(mrr-hsdRMS-mcrBC) φ80lacZΔM15 ΔlacX74 nupG recA1 araD139 Δ(ara-leu)7697 galE15 galK16 rpsL(Str$^R$) endA1 λ$^-$ | Invitrogen |
| Plasmids | | |
| pBBR1MCS2 | Broad-host range cloning vector; Km$^R$ | Kovach, M. E., P. H. Elzer, D. S. Hill, G. T. Robertson, M. A. Farris, R. M. Roop, 2nd, and K. M. Peterson. 1995. Four new derivatives of the broad-host-range cloning vector pBBR1MCS, carrying different antibiotic-resistance cassettes. Gene 166: 175-6 |
| pBBR1MCS5 | Broad-host range cloning vector; Gm$^R$ | Kovach, M. E., P. H. Elzer, D. S. Hill, G. T. Robertson, M. A. Farris, R. M. Roop, 2nd, and K. M. Peterson. 1995. Four new derivatives of the broad-host-range cloning vector pBBR1MCS, carrying different antibiotic-resistance cassettes. Gene 166: 175-6 |
| pSWU19 | Mx8 att site vector; Km$^R$ | Wang, J., Hu, W., Lux, R., He, X., Li, Y., and W. Shi. 2011. Natural transformation of *Myxococcus xanthus*. J Bacteriol 193(9): 2122-2132. |
| pJ201 | pUC ori, Km$^R$ | DNA 2.0, Menlo Park, CA |
| pBRL306 | pBBR1MCS-2, *Myxococcus xanthus* rpoN | This example |
| pBRL316 | pBBR1MCS-2, *P. putida* KT2440 rpoN | This example |

TABLE 1-continued

Strains and plasmids used in this example.

| Construct | Description | Reference or source |
|---|---|---|
| pBRL323 | pJ201, codon optimized synthetic RpoN region III from *A. aerolicus* (Leu338-Ile398) | This example |
| pBRL340 | pBBR1MCS-2, codon optimized synthetic RpoN region III from *A. aerolicus* (Leu338-Ile398) | This example |
| pBRL344 | pBBR1MCS-5, lacI$^Q$-controlled inducible trc-promoter | This example |
| pBRL348 | pBRL344, codon optimized synthetic RpoN region III from *A. aerolicus* (Leu338-Ile398) | This example |
| pBRL349 | pBRL348, Y48A RpoN (synthetic) | This example |
| pBRL354 | pSWU19, codon optimized synthetic RpoN region III from *A. aerolicus* (Leu338-Ile398) | This example |

Plasmid Construction and DNA Manipulation

TABLE 2

Sequences of oligonucleotides used in this example.

| Amplification product | Primer Name | Oligonucleotide sequence (5'-3') | SEQ ID NO. | Restriction Site |
|---|---|---|---|---|
| *P. putida* rpoN | BL321.f | GCAGCATATGAAACCATCGCTCGTCCTA | 10094 | Nde I |
|  | BL321.r | GCAGGAATTCCTACATCAGTCGCTTGCGTTC | 10095 | EcoR I |
| Y48A RpoN | BL330.f | CGTACGGTTGCCAAGGCTCGTGAGATGCTGGGTATTCCG | 10096 |  |
|  | BL330.r | CGGAATACCCAGCATCTCACGAGCCTTGGCAACCGTACG | 10097 |  |
| Sac I/EcoR I silent mutation of pBRL343 | BL331.f | GGAAACAGACCATGCAATTCCAGCTCGGTACCCGGGGATCC | 10098 |  |
|  | BL331.r | GGATCCCCGGGTACCGAGCTGGAATTGCATGGTCTGTTTCC | 10099 |  |
| lacI$^Q$-rpoN from pBRL348 | BL337.f | GAGCCCTAGGGCATGCATTTACGTTGACACCATC | 10100 | Avr II |
|  | BL337.r | GAGCCCTAGGTCAGAGCTCAATGCGGCGTTCAC | 10101 | Avr II |

The rpoN gene from *M. xanthus* DK1622 was PCR-amplified and subsequently cloned into pCR-Blunt (Invitrogen, Carlsbad, Calif.) according to the manufacturer's instructions. The rpoN gene was subsequently cloned into the Nde I and EcoR I sites of pET28b (Novagen, USA). For expression in bacteria other than *E. coli*, the *M. xanthus* rpoN-pET28b plasmid was digested with Xba I and Sac I to liberate the rpoN gene with the pET28b-derived ribosome binding site. This fragment was ligated into the Xba I/Sac I sites of pBBR1MCS-2 to give pBRL306.

The rpoN gene from *P. putida* was PCR-amplified (primers BL321.f/BL321.r) and subsequently cloned into pCR-Blunt (Invitrogen, Carlsbad, Calif.) according to the manufacturer's instructions to give pBRL310. *P. putida* rpoN was subsequently cloned from pBRL310 into the Nde I/EcoRI sites of pKH22 to give pBRL312. Lastly, pBRL312 was digested with Xba I/Sac I, and the released rpoN fragment was ligated into the Xba I/Sac I sites of pBBR1MCS-2 to yield pBRL315.

A plasmid for the strict and inducible expression of recombinant genes in *P. aeruginosa* was constructed. First, the vector pTrc99a was digested with Sph I and Xba I to release the lacI$^Q$ gene, trc-promoter and the MCS. This fragment was subsequently ligated into the corresponding Sph I/Xba I sites of pBBR1MCS-5 to yield the plasmid pBRL343. For cloning purposes, the Sac I and EcoR I sites of the pTrc99a MCS fragment were removed from pBRL343 via site-directed mutagenesis (primers BL331.f/BL331.r) using the QuikChange™ kit (Stratagene, California) to liberate pBRL344.

A gene encoding the last (C-terminal) 60 amino acid residues of RpoN from *Aquifex aeolicus* was synthesized and optimized to *E. coli-codon* usage by DNA2.0 (Menlo Park, Calif.). Both the amino acid (ORF of 60 amino acids) and DNA sequences (195 base pairs) are given in Table 3 for the engineered rpoN construct (also known as RpoN* or σ54*). For expression purposes, the engineered rpoN construct was cloned from pBRL323 into the Xba I/Sac I sites of pBRL344 to give pBRL348. To generate an attenuated RpoN*, the tyrosine at position 48 was changed into alanine (primers BL330.f/BL330.r) using the Quikchange™ kit (Stratagene, California) with pBRL348 as the template. The resulting plasmid pBRL349 thus contained a Y48A RpoN* protein.

TABLE 3

Nucleotide and amino acid sequence of codon optimized synthetic RpoN region III from *A. aerolicus*.

| | | |
|---|---|---|
| Nucleotide Sequence | 5'-CATATGCTGACCCAAGGCGAACTGATGAAACTGAT CAAAGAAATCGTGGAGAATGAGGACAAGCGTAAAC CGTACAGCGATCAGGAGATCGCGAACATTTTGAAA GAGAAGGGTTTCAAGGTCGCACGCCGTACGGTTGC CAAGTATCGTGAGATGCTGGGTATTCCGTCCAGCC GTGAACGCCGCATTGAGCTC-3' | SEQ ID NO. 10102 |
| Amino Acid Sequence | MLTQGELMKLIKEIVENEDKRKPYSDQEIANILKEKGFK VARRTVAKYREMLGIPSSRERRIEL | SEQ ID NO. 10103 |

RpoN* was shuttled into the *M. xanthus* Mx8 att-site integration vector, pSWU19. First, the lacI$^Q$-rpoN cluster from pBRL348 was PCR-amplified (see Table 2 for primers, BL337.f/BL337.r) and cloned into pCR-Blunt (Invitrogen, Carlsbad, Calif.) according to the manufacturer's instructions to give pBRL353. The lacI$^Q$-rpoN fragment was then excised from pBRL353 by Avr II digestion, and then subsequently ligated into the Xba I site of pSWU19 to yield pBRL354.

Plasmids were introduced into *P. putida*, *B. cepacia* and *P. aeruginosa* using previously established electroporation methods (Wang, Q., A. P. Mueller, C. R. Leong, K. Matsumoto, S. Taguchi, and C. T. Nomura. 2010. Quick and efficient method for genetic transformation of biopolymer-producing bacteria. J Chem Technol Biotechnol 85:775-778). A BTX Harvard apparatus ECM 399 was used for all electroporations.

Swarming and Twitching Motility Assays

Swarming and twitching motility were done as described previously (O'Toole, G. A., and R. Kolter. 1998. Flagellar and twitching motility are necessary for *Pseudomonas aeruginosa* biofilm development. Mol Microbiol 30:295-304). Plates used in motility assays were supplemented with 2 mM IPTG.

For *P. putida*, individual colonies were stabbed onto M63 minimal media plates supplemented with 0.5% glucose, 0.5% casamino acids (CAA) and 0.3% Difco™ agar. The resulting plates were grown at 30° C. for 24 h at which time motility was assessed.

For *B. cepacia*, individual colonies were stabbed onto LB plates with 0.2% glucose and 0.3% agar. Plates were incubated at either 30 or 37° C. for 24 h.

For *P. aeruginosa*, individual colonies were stabbed onto either i) M63 minimal media plates supplemented with 0.5% glucose, 0.5% CAA and 0.3% agar or ii) LB plates with 0.5% CAA and 0.3% agar. Plates were incubated at 25, 30 or 37° C. for 24 h.

Pyocyanin Production

Production of pyocyanin from *P. aeruginosa* in LB was determined as described (Dong, Y.-H., X.-F. Zhang, H.-M. L. Soo, E. P. Greenberg, and L.-H. Zhang. 2005. The two-component response regulator PprB modulates quorum-sensing signal production and global gene expression in *Pseudomonas aeruginosa*. Mol Microbiol 56:1287-1301). Briefly, 2 mL of LB was inoculated with 0.5% of seed culture and then grown to an OD$_{600}$ of 0.3 at 37° C., 250 rpm. IPTG was added to a final concentration of 2 mM, and the induced cultures were grown for 16 h at 37° C., 250 rpm. After incubation, cells were cleared by passage through a 0.2 micron filter, and the pyocyanin was extracted from 1.5 ml of the cell-free broth by the addition of 1 ml of chloroform. The resulting chloroform phase was then extracted with an equal volume of 0.2 M HCl, and the aqueous phase was assayed at 520 nm for pyocyanin.

Protease Assays

Protease activity was assessed by patching individual *P. aeruginosa* colonies onto either LB or LB plus 2% skim milk plates, which were supplemented with 2 mM IPTG. Patched plates were incubated at 25, 30 or 37° C. for 24 h. Breakdown of protein was determined by colony and/or halo formation.

Elastase activities of cell-free broth from *P. aeruginosa*-cultures grown in PTSB (5% peptone, 0.25% tryptic soy broth) were measured by breakdown of elastin-congo red complex as described (Dong, Y.-H., X.-F. Zhang, H.-M. L. Soo, E. P. Greenberg, and L.-H. Zhang. 2005. The two-component response regulator PprB modulates quorum-sensing signal production and global gene expression in *Pseudomonas aeruginosa*. Mol Microbiol 56:1287-1301; Ohman, D. E., S. J. Cryz, and B. H. Iglewski. 1980. Isolation and characterization of *Pseudomonas aeruginosa* PAO mutant that produces altered elastase. J Bacteriol 142:836-842). Briefly, 1.8 mL of PTSB was inoculated with 0.5% of seed culture and subsequently grown at 37° C., 250 rpm until an OD$_{600}$ of 0.1 was reached. At that time, gene expression was induced with a final concentration of 2 mM IPTG, and the cultures were grown for a total of 16 h post induction. Following incubation, the broth was passed through a 0.2-micron filter to remove the cells, and 1 ml of the resulting cell-free filtrate was added to 2 ml of elastase reaction buffer (0.1 M Tris, pH 7.2, 1 mM $CaCl_2$, 10 mg $ml^{-1}$ elastin-congo red). Reactions were carried out at 37° C. for 7 h. Subsequently, insoluble material in the reaction mixture was removed by centrifugation, and the resulting supernatant was assayed at an absorbance of 459 nm.

Hemolysin Assays

Individual *P. aeruginosa* colonies were patched onto LB plates supplemented with 0.5% CAA and 5% sheep blood. Hemolytic activity was determined after 24 h of growth at 37° C.

Growth of *E. coli* MG1655 on W-Salt Minimal Plates

*E. coli* MG1655 harboring either pSWU19 or pBRL354 were patched onto W-salt plates (per liter: 10.5 g $K_2HPO_4$, 4.5 g $KH_2PO_4$, 0.261 ml of 1 M $MgSO_4.7H_2O$, 5 g glucose) supplemented with 0.4% $(NH_4)SO_4$ or 0.2% L-glutamine as the sole nitrogen source, and 2 mM IPTG. Patched plates were grown at 37° C. for 24-48 h.

Results

Motility is Inhibited when RpoN is Overexpressed

RpoN is known to be essential for motility in several pseudomonads such as *P. putida* and *P. aeruginosa*. Indeed, expression of several vital motility genes is mediated through the RpoN-RNAP holoenzyme in an EBP-dependent manner. To show that a non-native RpoN could effectively compete with an organism's native $\sigma^{54}$ due to the universal-nature of the -12/-24 promoter, the full-length RpoN protein from the distantly related *M. xanthus* was overexpressed in *P. putida* KT2440. As expected, motility on M63 soft agar plates was completely abolished for *P. putida* when expressing *M. xanthus* RpoN (FIG. 4); *P. putida* harboring the *M. xanthus* RpoN were also observed to 'sink' in LB-liquid culture, thus suggesting defects in swimming motility. Interestingly, overexpression of the *P. putida*'s native RpoN significantly reduced motility (FIG. 4). These results suggested that overexpression of full length RpoN can antagonize motility in *P. putida*.

It has been shown that the last 60 amino acids (region III) of RpoN are sufficient for recognition and binding to the -24 element of the $\sigma^{54}$ promoter. Because of the conservation of both the -24-promoter element and region III of RpoN, we hypothesized that a peptide composed of only the region III amino acid residues would be sufficient for antagonizing genome-wide transcription at $\sigma^{54}$ promoters. This is determined by Doucleff et al. 2007. To this end, a peptide was synthesized to resemble region III (Leu338-Ile398) of RpoN from the thermophilic bacterium *A. aeolicus* and was codon-optimized for expression in *E. coli*.

Figure 5:
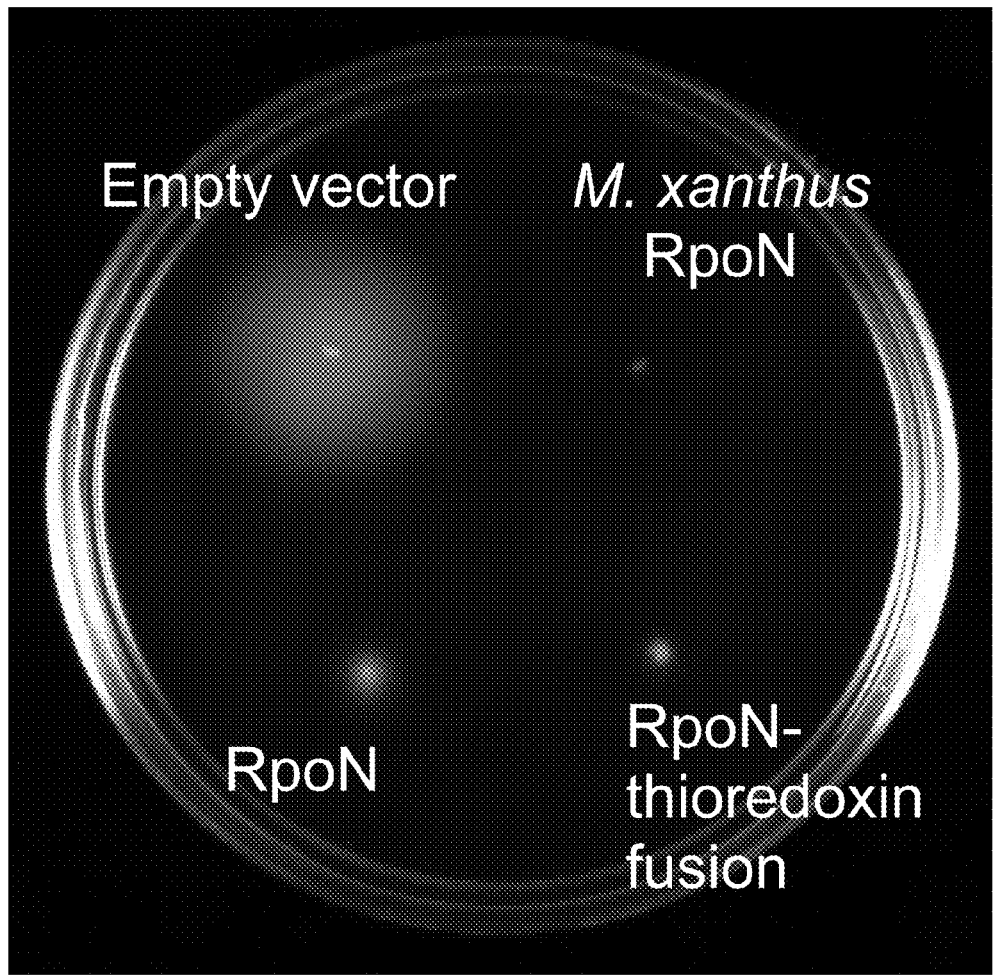
FIG. 5: *P. putida* KT2440 motility on M63 soft agar expressing i) pBRL344 (empty vector), ii) *M. xanthus* RpoN, iii) truncated RpoN, or iv) thioredoxin-RpoN fusion protein.

Introduction of the synthetic, truncated RpoN into *P. putida* KT2440 generated strains incapable of moving on M63 soft agar plates (FIG. 5). When the RpoN construct was attenuated by replacing the tyrosine residue in the RpoN box motif with alanine (Y48A), motility was only impaired and not absent. This suggested that the antagonizing effect of RpoN can be localized to region III and its interaction with the -24 element of $\sigma^{54}$ promoters in the bacterial genome.

Figure 6:
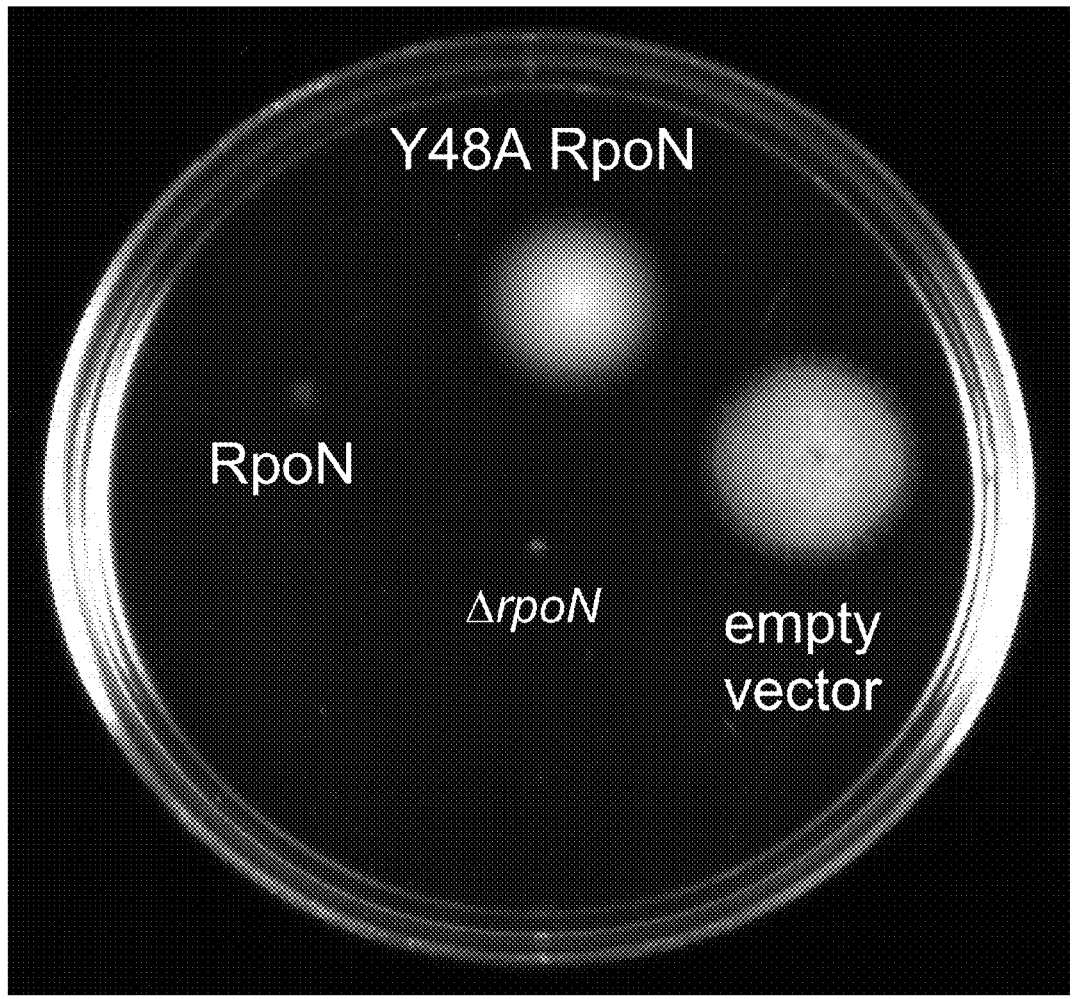
FIG. 6: *P. aeruginosa* PAO1 motility on M63 soft agar expressing i) pBRL344 (empty vector), ii) truncated RpoN, or iii) Y48A RpoN. The ΔrpoN PAO1 strain was used as a control.
Figure 7:
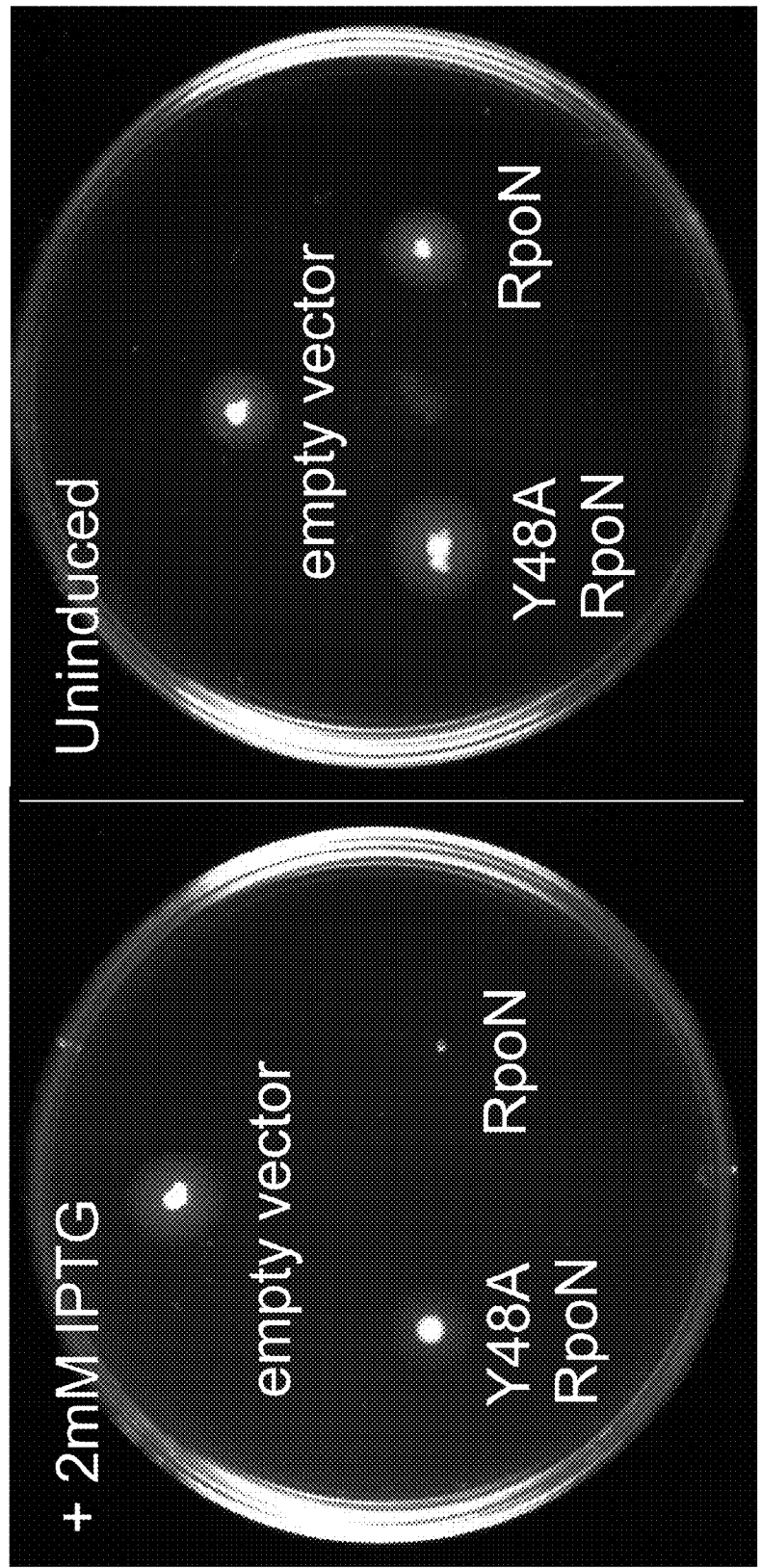
FIG. 7: *P. aeruginosa* PAO1 twitching motility when expressing i) pBRL344 (empty vector), ii) truncated RpoN, or iii) Y48A RpoN.
Figure 8:
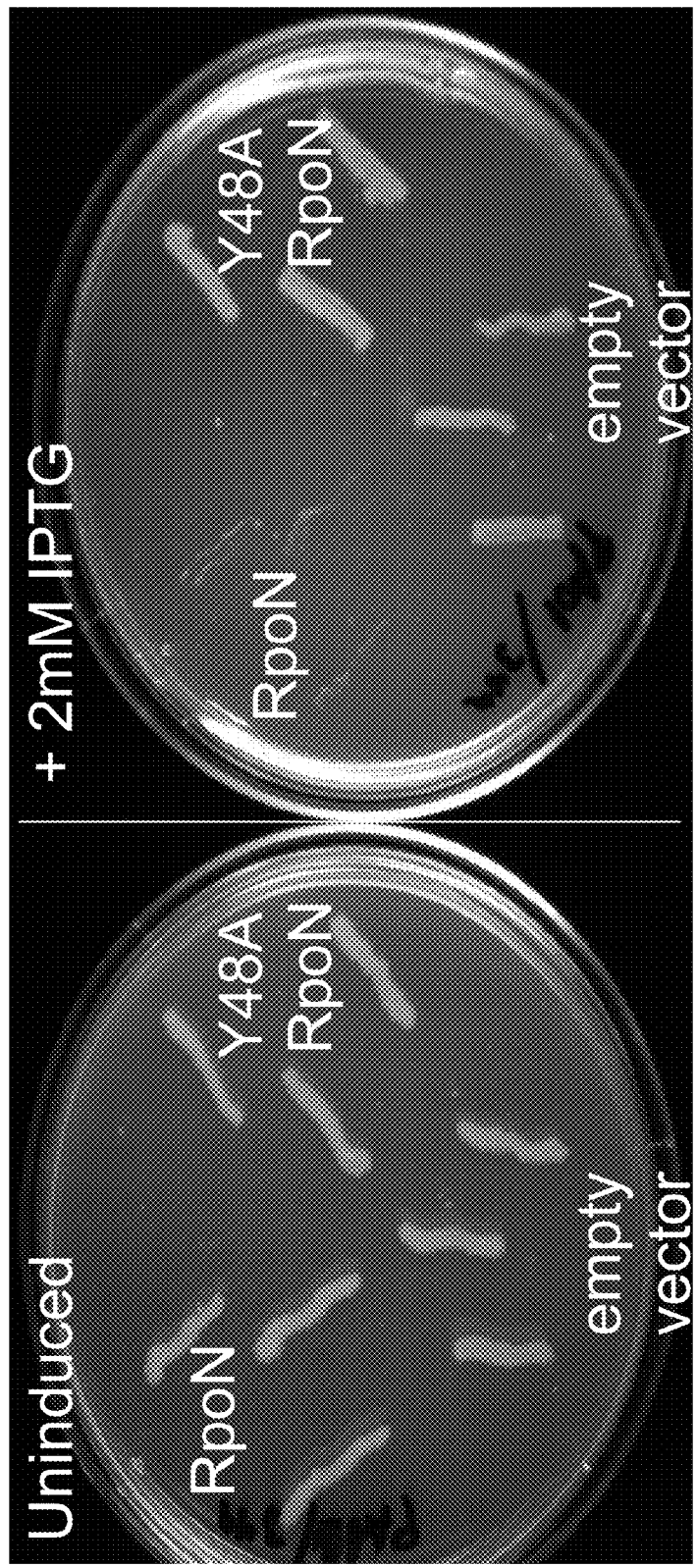
FIG. 8: *P. aeruginosa* PAO1 growth on Lennox broth solid media when expressing i) pBRL344 (empty vector), ii) truncated RpoN, or iii) Y48A RpoN.
Figure 10:
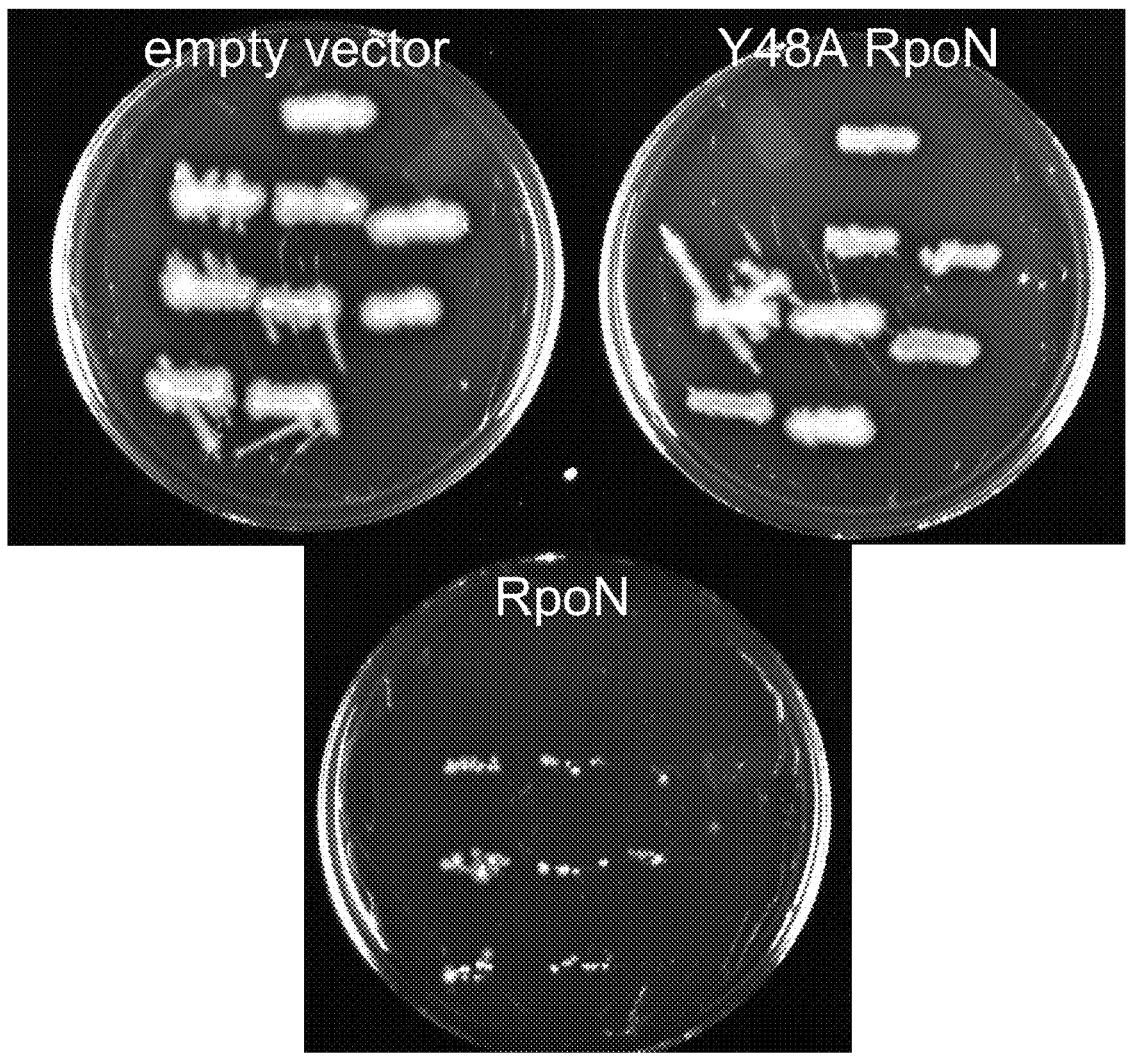
FIG. 10: *P. aeruginosa* PAO1 growth LB+5% sheep blood expressing i) pBRL344 (empty vector), ii) truncated RpoN, or iii) Y48A RpoN.
Figure 11:
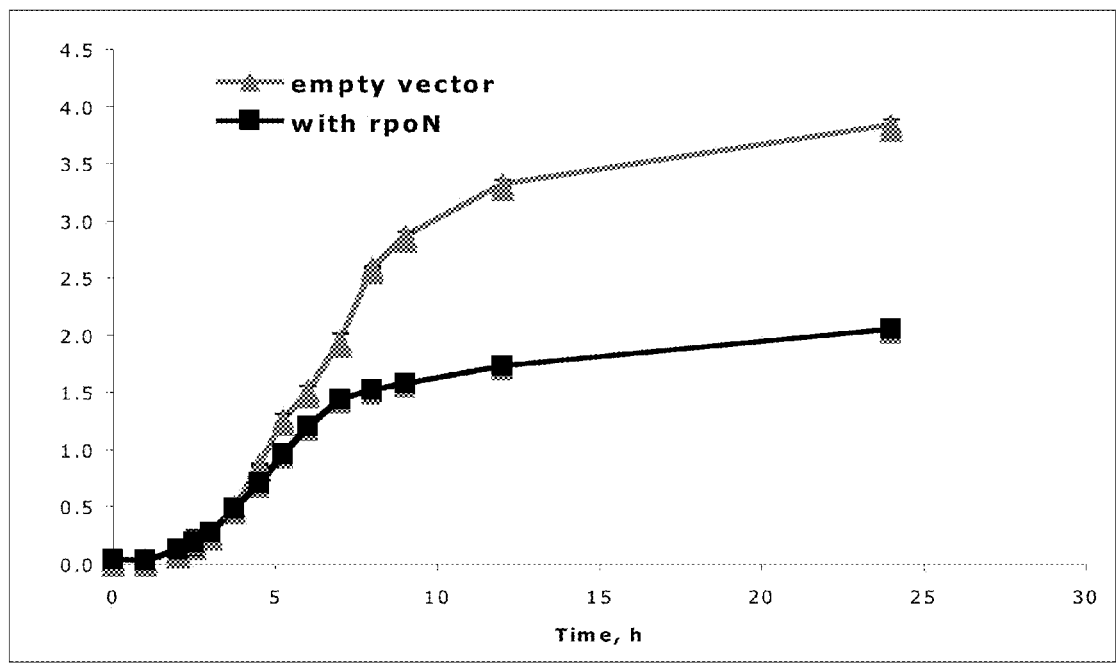
FIG. 11: *P. aeruginosa* PAO1 growth in LB expressing either i) pBRL344 (empty vector) or ii) synthetic, truncated RpoN.

The synthetic, truncated RpoN was then expressed in a medically relevant bacterium, *P. aeruginosa* PAO1. As for the case of *P. putida*, overexpression of RpoN in *P. aeruginosa* PAO1 inhibited motility on semisolid plates consisting of either minimal or rich media (FIG. 6 and FIG. 7). Motility is known to require RpoN in *P. aeruginosa*, and the heterologously expressed RpoN peptide antagonized motility, and as shown below, other virulent factors associated with this opportunistic pathogen.

Virulence Factors are Negatively Affected by RpoN Overexpression

Figure 12:
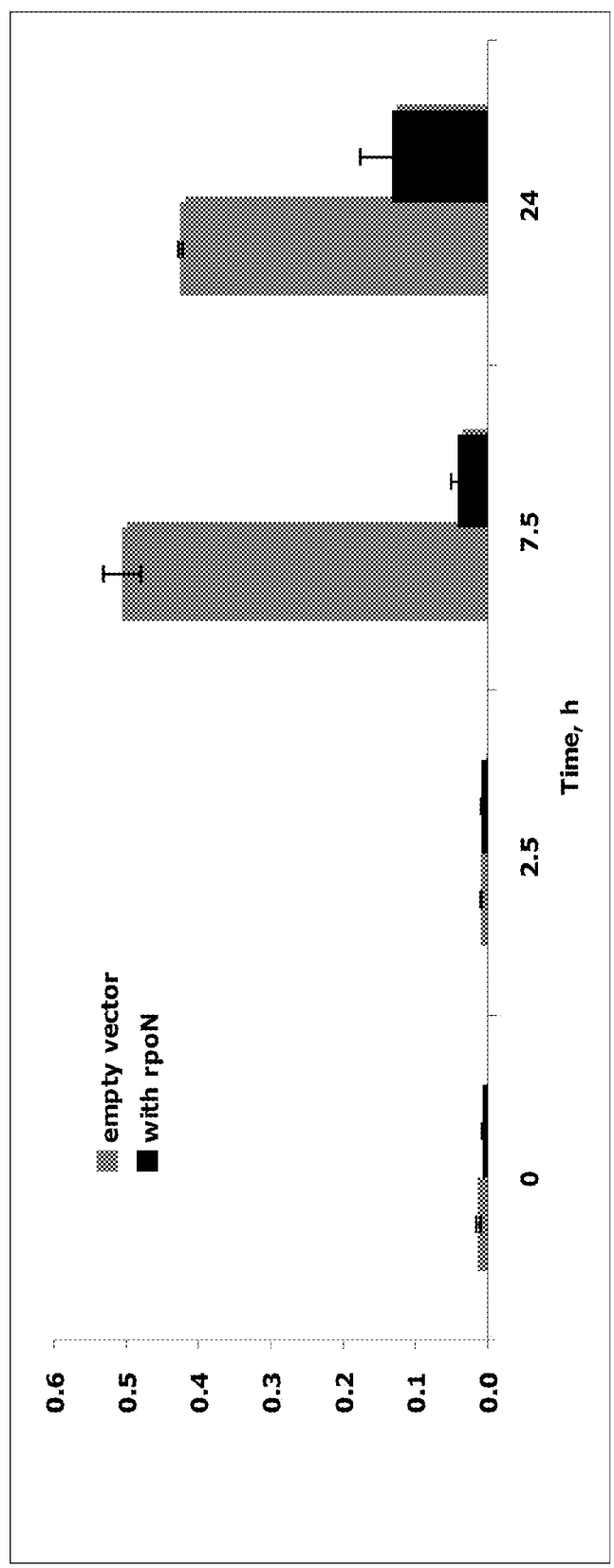
FIG. 12: Elastase production *P. aeruginosa* PAO1 in PTSB media expressing either i) pBRL344 (empty vector) or ii) synthetic, truncated RpoN. Elastase activity was measured at 0, 2.5, 7.5 or 24 h post inoculation. Note that 7.5 h time point represents 4 h post induction.

A notable characteristic of *P. aeruginosa* harboring the synthetic, truncated RpoN was its inability to breakdown protein. Extracellular proteases such as elastase and protease IV are critical virulent factors of *P. aeruginosa*. *P. aeruginosa* PAO1 strains possessing the synthetic, truncated RpoN failed to grow on a variety of rich media: LB, LB+2% milk, LB+5% sheep's blood, PTSB (5% peptone, 0.25% yeast extract) or King's B medium (FIGS. 8-11). Media had to be supplemented with CAA to promote a slow growth of PAO1/pBRL348 strains. Importantly, elastase, which serves as the major protease of *P. aeruginosa*, was found to be <10-fold active (FIG. 12) in spent PTSB-medium of PAO1/pBRL348 than that of wildtype (PAO1/pBRL344). Microarray analysis indicated that expression of the elastase genes, lasA and lasB, were downregulated by 11- and 36-fold, respectively, in PAO1/pBRL348 cells.

Figure 13:
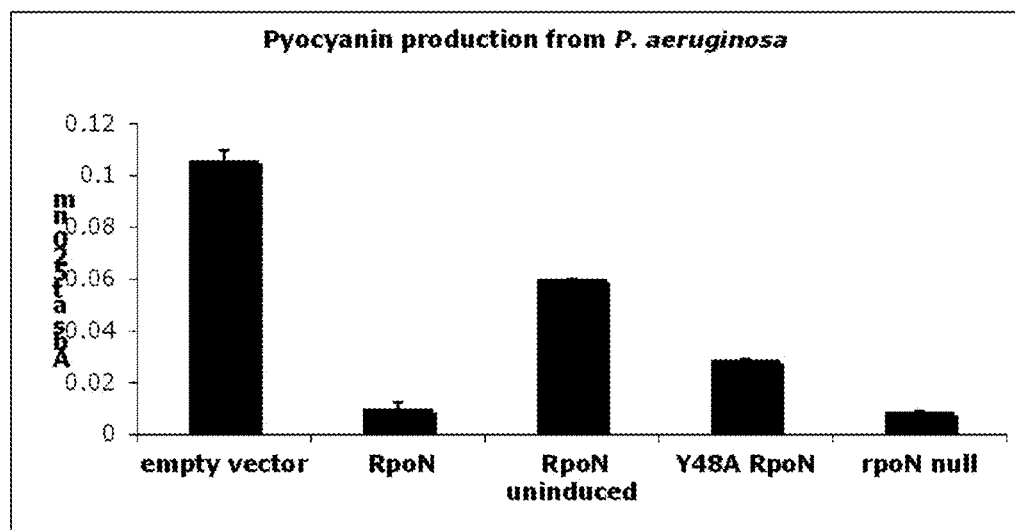
FIG. 13: Pyocyanin production *P. aeruginosa* PAO1 in LB media expressing either i) pBRL344 (empty vector), ii) synthetic, truncated or iii) Y48A RpoN. The ΔrpoN PAO1 strain was used as a control.

Another extracellular virulent factor associated with *P. aeruginosa* is the redox active phenazine compound pyocyanin. Pyocyanin production was significantly lower (<10 fold) for PAO1 when expressing the synthetic, truncated RpoN (FIG. 13). Microarray analysis showed that genes involved in the biosynthesis of phenazines were downregulated by 20-80 fold in PAO1/pBRL348 cultures.

RpoN Antagonism in Other Bacteria

Figure 14:
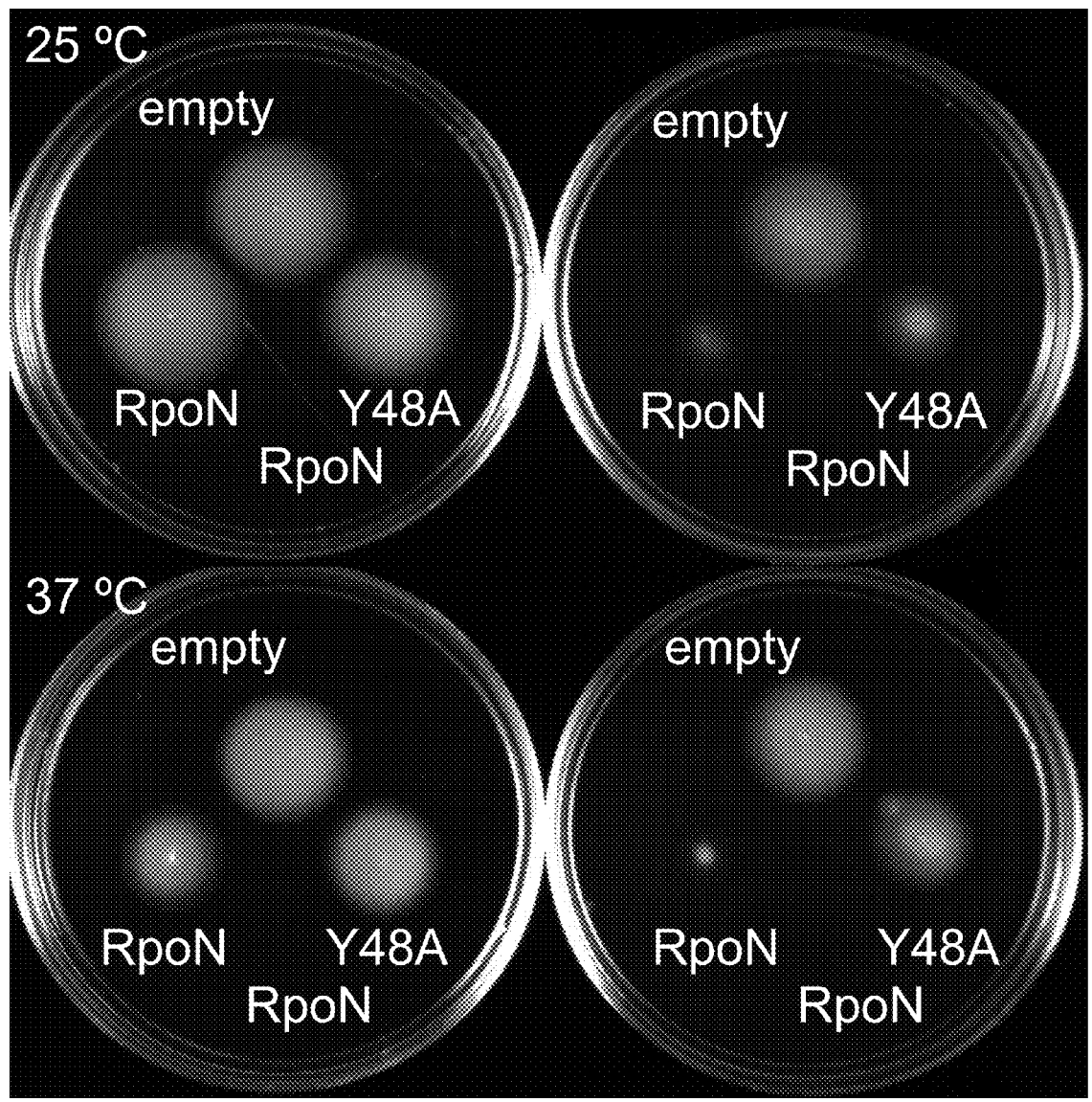
FIG. 14: Motility of *B. cepacia* on LB soft agar expressing either i) pBRL344 (empty vector), ii) synthetic, truncated or iii) Y48A RpoN.
Figure 15:
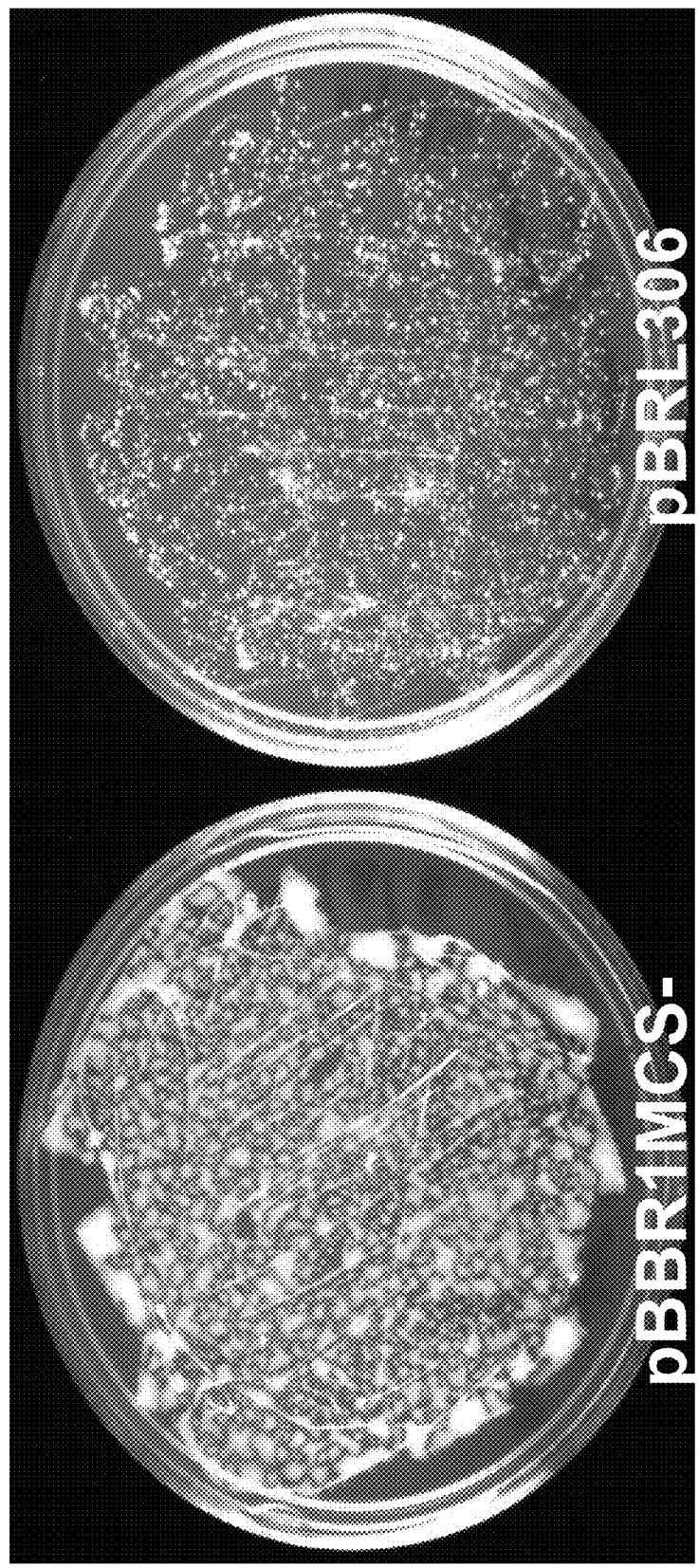
FIG. 15: Extracellular polysaccharide production from *R. solanacearum* expressing either pBBR1MCS-2 or *M. xanthus* rpoN (pBRL306).
Figure 16:
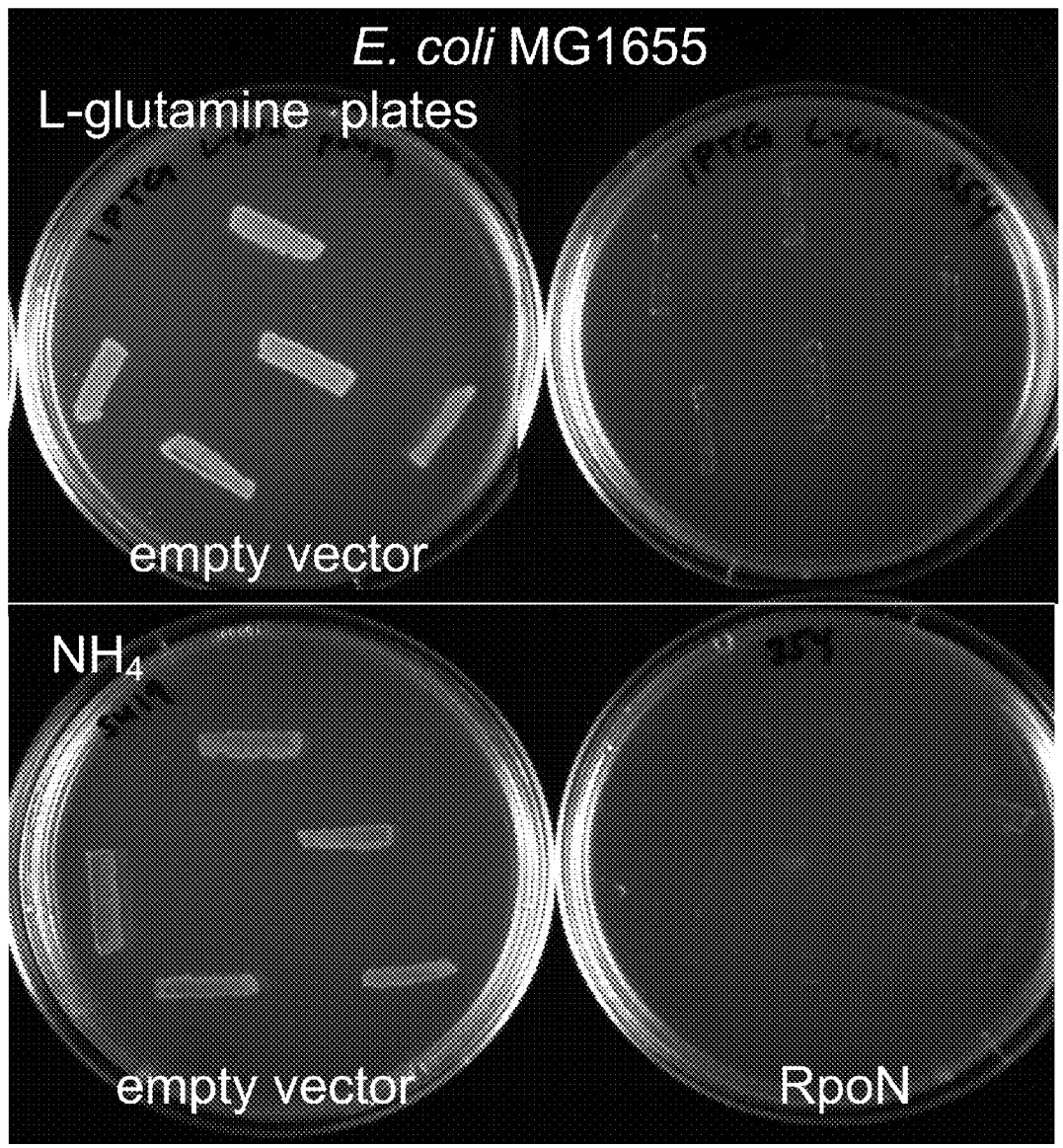
FIG. 16: Growth of *E. coli* MG1655 on W-salt agar plates with either L-Gln or ammonia as the sole nitrogen source.

To examine a broader impact of RpoN antagonism, RpoN was overexpressed in a variety of bacterial species. First, the synthetic, truncated RpoN was introduced into the human pathogen *B. cepacia*, and motility was assessed on LB-semisolid media. As shown in FIG. 14, *B. cepacia*/pBRL348 displayed impaired motility compared to the wildtype (*B. cepacia*/pBRL344). RpoN is required for motility in *Burkholderia*, and our results support the antagonistic nature of the synthetic, truncated RpoN with *B. cepacia* $\sigma^{54}$ promoters. In contrast to motility, we found a significant reduction in the extracellular polysaccharide (EPS) produced by the plant-pathogen *R. solanacearum* when it overexpressed the rpoN gene from *M. xanthus* (FIG. 15). And lastly, overexpression of the synthetic, truncated RpoN in *E. coli* MG1655 altered its metabolism of nitrogenous sources as shown in FIG. 16. As predicted, growth could be sustained on minimal media when L-glutamine but not ammonia was the sole nitrogen source.

Example 2

Method for Screening for RpoN -24 Binding Motifs

This example describes a method for examining the repression and/or interference of RpoN proteins and RpoN binding motif preferences and/or substrate specificity.

To screen -24 elements (nucleotide sequences) for RpoN binding, a plasmid-based reporter assay was developed. Nucleotide sequences, which comprised GTTGGXXXXTT (where X is any nucleotide depending on the -24 element, see Table 4), were introduced, using standard methods known in the art, between the lac promoter and RBS for the mCherry gene in the pmCherry plasmid (Clontech) via site-directed mutagenesis (Quikchange™, Stratagene). Binding of RpoN to the introduced, -24 element impedes $P_{lac}$-mediated transcription of the mCherry gene, thus reducing gene expression of the fluorescent mCherry protein.

TABLE 4

| Construct | -24 element or full promoter (italics) | -12/24 Forward (f) and reverse (r) primers used for site-directed mutagenesis with pmCherry (Clontech) |
|---|---|---|
| pmcherry-346 | GT-*TGGCACG*-TT [SEQ ID NO: 10104] | f-gagcggataacaattgttggcacgttcacacaggaaacagc [SEQ ID NO: 10105] r-gctgtttcctgtgtgaacgtgccaacaattgttatccgctc [SEQ ID NO: 10106] |
| pmcherry-347 | GT-*TGGTACA*-TT [SEQ ID NO: 10107] | f-gagcggataacaattgttggtacattcacacaggaaacagc [SEQ ID NO: 10108] r-gctgtttcctgtgtgaatgtaccaacaattgttatccgctc [SEQ ID NO: 10109] |
| pmcherry-348 | GT-*TGGCCCA*-TT [SEQ ID NO: 10110] | f-gagcggataacaattgttggcccattcacacaggaaacagc [SEQ ID NO: 10111] r-gctgtttcctgtgtgaatgggccaacaattgttatccgctc [SEQ ID NO: 10112] |
| pmcherry-350 | GT-*TCCCACG*-TT [SEQ ID NO: 10113] | f-gagcggataacaattgttcccacgttcacacaggaaacagc [SEQ ID NO: 10114] r-gctgtttcctgtgtgaacgtgggaacaattgttatccgctc [SEQ ID NO: 10115] |
| pmcherry-351 | GT-*TGGCACGGCCGTTGCT*-TA [SEQ ID NO: 10116] | f-gagcggataacaattgttggcacggccgttgctattcacacaggaaacagc [SEQ ID NO: 10117] r-gctgtttcctgtgtgaatagcaacggccgtgccaacaattgttatccgctc [SEQ ID NO: 10118] |
| pmcherry-352 | GT-*TGGCACAGATTTCGCT*-TT [SEQ ID NO: 10119] | f-gagcggataacaattgttggcacagatttcgctttcacacaggaaacagc [SEQ ID NO: 10120] r-gctgtttcctgtgtgaaagcgaaatctgtgccaacaattgttatccgctc [SEQ ID NO: 10121] |

The −24-element bearing pmCherry constructs were transformed into either JM109/pBRL340 or Top10/pBRL348 *E. coli* cells, which harbored the truncated, synthetic RpoN. Strains were grown in 20 mL of LB (in a 500-mL baffled shake flask) with the appropriate antibiotics at 37° C., 250 rpm, until an $OD_{600}$ of 0.2 was reached. At this time, lacI$^Q$-repression was relieved by the addition of 0.5 mM IPTG, and the induced *E. coli* cultures were grown for an additional 8 h at 37° C., 250 rpm. For extraction of mCherry, a total of 1.5 mL of each culture was harvested, and the resulting cell pellet was suspended in 0.6 mL of B-PER Bacterial Protein Extraction Reagent (Thermo Scientific, cat no. 78243). Suspensions (extractions) were incubated at 25° C. for 20 min, and then the unlysed cells and cellular debris were removed by centrifugation. Cleared supernatants were assayed at 586 nm for mCherry activity.

Figure 17:
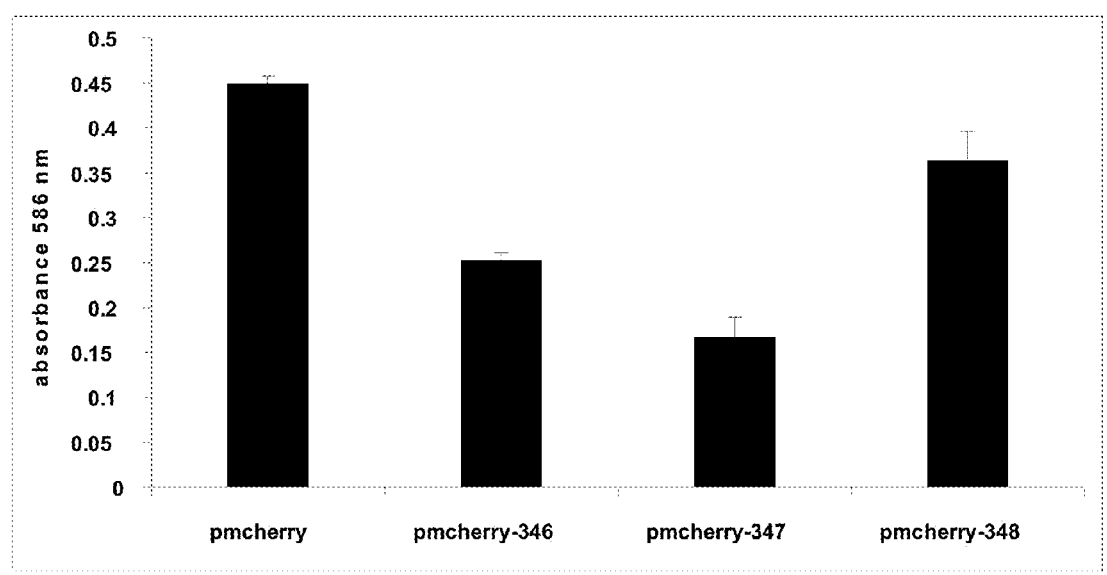
FIG. 17: Expression of pmcherry from the Plac-RpoN promoter is reduced in the presence of the synthetic RpoN.
Figure 18:
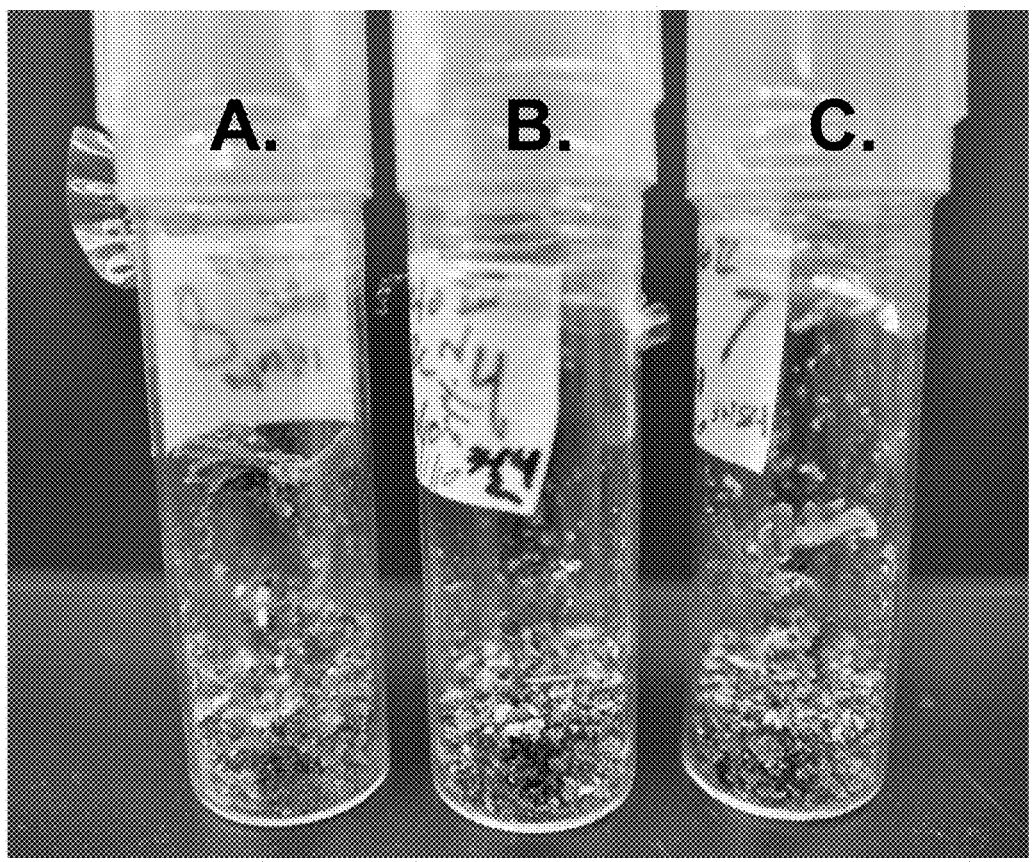
FIG. 18: Effect of synthetic RpoN on *R. solanacearum* plant pathogenicity. A. Untreated tomato seedling control. B. Tomato seedling treated with *R. solanac

Results are shown in FIG. 17. FIG. 17 shows expression of pmCherry from the $P_{lac}$-RpoN promoter is reduced in the presence of the synthetic RpoN.

These results demonstrate that there is a binding preference for the −24 binding motif by the RpoN box binding domain and that this domain can directly interfere with expression of genes downstream.

Example 3

Method for Preventing Virulence by *Ralstonia solanacearum* Against Tomato Plants This example demonstrates that the RpoN synthetic peptide can be used to repress plant pathogenicity in *Ralstonia solanacearum* (formerly *Pseudomonas solanacearum*). *R. solanacearum* harboring either pBRL344 or pBRL348 was grown in BG medium supplemented with 15 μg $mL^{-1}$ gentamicin at 30° C./250 rpm until an $OD_{600}$ of 0.3 was reached. At this time, IPTG was added to a final concentration of 2 mM, and the induced cultures were grown for 16 h at 30° C. at 250 rpm. Pathogenicity of the treated (induced) *R. solanacearum* cultures was tested on tomato seedlings as described by Boucher, C. A. et al., Transposon mutagenesis of *Pseudomonas solanacearum*: Isolation of Tn5-induced avirulent mutants. J. Gen. Microbiol. 1985, 131, 2449-2457.

FIG. 18 shows the effect of synthetic RpoN on *R. solanacearum* plant pathogenicity. FIG. 18A shows an untreated tomato seedling control. FIG. 18B shows a tomato seedling treated with *R. solanacearum* harboring empty vector. FIG. 18C shows a tomato seedling treated with *R. solanacearum* harboring pBRL348 expressing synthetic RpoN*. Under the conditions described, the RpoN synthetic molecule repressed pathogenesis of *R. solanacearum.*

Example 4

Microarray Analysis

This example demonstrates a microarray analysis to determine RpoN regulons and identify cryptic promoters. Over 300 genes were downregulated in *P. aeruginosa* overexpressing RpoN.

To get a global picture of how overexpression of RpoN alters the transcriptome of *P. aeruginosa*, PAO1/pBRL348 or PAO1/pBRL344 cells were grown to the exponential state in LB media at which time total RNA was isolated and subjected to Affymetrix GeneChip® analysis. Many genes involved in quorum sensing (QS) and/or products of QS were significantly downregulated in PA01/pBRL348. For example, the major QS-transcriptional regulator, RhlR, which responds to N-butanoyl-homoserine lactone, experienced a 4-fold reduction in expression. Also, genes that are controlled by the *Pseudomonas* quinolone signal (PQS), e.g., hcnB, chiC, and lecAB, were significantly downregulated.

Four replicates were done per strain tested. For each replicate, an individual colony of P. aeruginosa PAO1/pBRL344 or PAO1/pBRL348 was grown in 1.5 ml of LB at 37° C., and shaking at 250 rpm for 16 h. From this seed culture, 0.25 ml was used to inoculate 50 ml of LB in a 500-ml baffled shake flask. Cultures were grown at 37° C., 250 rpm until an $OD_{600}$ of 0.3 was reached. Cultures were induced with IPTG at a final concentration of 2 mM and grown for 2 h post induction ($OD_{600}$ of 1.5). At this time, 0.5 ml of culture was added to 1 ml of RNAprotect bacterial reagent, and the total RNA was subsequently extracted by performing an enzymatic lysis and proteinase K digestion, followed by purification with the RNeasy Mini kit (Qiagen, California). The purified RNA from all four replicates was combined and then split into four equal parts. The resulting RNA samples were checked for DNA contamination by both PCR and through a Bioanalyzer (Agilent). Microarray experiments were carried out by the Microarray Core Facility (Upstate Medical University, Syracuse, N.Y.) using Affymetrix P. aeruginosa PAO1 GeneChip® arrays.

Microarray studies were performed according to the Affymetrix GeneChip® Expression Analysis Technical Manual (Affymetrix publication 702232 Rev. 3) and previously published protocols (Middleton, F. A., K. Carrierfenster, S. M. Mooney, and S. L. Youngentob. 2009. Gestational ethanol exposure alters the behavioral response to ethanol odor and the expression of neurotransmission genes in the olfactory bulb of adolescent rats. Brain Res 1252:105-16). The pooled RNA samples were used to produce cDNA and profiled using the Affymetrix P. aeruginosa PAO1 GENECHIP® (Affymetrix, Santa Clara, Calif.). This array contains probe sets for over 5,500 ORFs from the PAO1 strain of P. aeruginosa, 199 probe sets corresponding to 100 intergenic sequences, and 117 additional genes from P. aeruginosa strains other than PAO1. The GeneChips were hybridized with constant rotation, then washed and stained on the Fluidics Station according to the Prokaryotic Target Hybridization protocols in the GeneChip Expression Analysis Technical Manual (Affymetrix publication 702232 Rev. 3). Affymetrix software (MicroArray Suite 5.0; MASS) was initially used to perform quality control (Q/C) analysis, calculate the signal intensities from each perfect match prove on the arrays relative to the mismatch probe, and to determine whether or not the gene was present in the sample. After obtaining these metrics, the RMA method was used to normalize the set of arrays in our screen (GeneTraffic software, Stratagene, La Jolla, Calif.). The two pairs of arrays consisting of four chips per condition (empty vector vs. synthetic RpoN in wild type P. aeruginosa and empty vector vs. synthetic RpoN in the rpoN null P. aeruginosa strain) were compared using a simple pairwise t-test with P value adjustment using variance inflation.

Analysis of the data was carried out on the normalized RMA files generated by microarray experiment using MeV from the TM4 Microarray Software Suite (Saeed, A., N. Bhagabati, V. Sharov, E. Howe, J. Li, M. Thiagarajan, J. White, and J. Quackenbush. 2006. TM4 microarray software suite. Meth Enz 411:134-193; Saeed, A., V. Sharov, J. White, J. Li, W. Liang, N. Bhagabati, J. Braisted, M. Klapa, T. Currier, M. Thiagarajan, A. Sturn, M. Snuffin, A. Rezanstev, D. Popov, A. Ryltsov, E. Kostukovich, I. Borsovsky, Z. Liu, A. Vinsavich, V. Trush, and J. Quackenbush. 2003. TM4: a free, open-source system for microarray data management and analysis. Biotechniques 34:374-378).

The results of the microarray analysis are shown in Tables 5-8.

Table 5 shows that these genes are under the control of more than one promoter, including sigma 54 because they are down regulated in both the wild type and native RpoN deletion strains of P. aeruginosa. The underscore represents no gene name associated with the protein. Negative numbers indicate the fold difference in expression of the gene as compared to a wild type strain.

TABLE 5

Genes that are down regulated in both P. aeruginosa PAO1 and P. aeruginosa ΔrpoN (PA06359) expressing synthetic RpoN

| Gene | | | Fold Change | |
|---|---|---|---|---|
| Locus | name | Biological function | PAO1 | PAO6359 |
| PA0200 | — | hypothetical protein | −33.3 | −2.24 |
| PA0459 | — | ClpA/B protease ATP binding subunit | −6.53 | −2.07 |
| PA0542 | — | hypothetical protein | −2.98 | −2.2 |
| PA0852 | cbpD | chitin-binding protein CbpD precursor | −11.61 | −2.15 |
| PA1216 | — | hypothetical protein | −2.98 | −5.82 |
| PA1544 | anr | transcriptional regulator Anr | −2.2 | −2.13 |
| PA1677 | — | hypothetical protein | −2.49 | −4.83 |
| PA1901 | phzC2 | phenazine biosynthesis protein PhzC | −18.51 | −3.18 |
| PA1903 | phzE2 | phenazine biosynthesis protein PhzE | −16.85 | −4.08 |
| PA1904 | phzF2 | phenazine biosynthesis protein | −15.94 | −4.03 |
| PA1905 | phzG2 | pyridoxamine 5′-phosphate oxidase | −22.12 | −4.89 |
| PA2008 | fahA | fumarylacetoacetase | −8.85 | −2.01 |
| PA2009 | hmgA | homogentisate 1,2-dioxygenase | −5.85 | −2.26 |
| PA2031 | — | hypothetical protein | −4.21 | −2.27 |
| PA2067 | — | hydrolase | −3.25 | −2.4 |
| PA2069 | — | carbamoyl transferase | −6.06 | −3.54 |
| PA2193 | hcnA | hydrogen cyanide synthase | −6.43 | −1.88 |
| PA2194 | hcnB | hydrogen cyanide synthase | −5.1 | −1.84 |
| PA2805 | — | hypothetical protein | −4.1 | −2.45 |
| PA3309 | — | hypothetical protein | −3.4 | −2.45 |
| PA3326 | — | ATP-dependent Clp protease proteolytic subunit | −3.71 | −2.97 |
| PA3477 | rhlR | transcriptional regulator RhlR | −4.16 | −2.81 |
| PA3724 | lasB | elastase LasB | −41.43 | −3.23 |
| PA3831 | pepA | leucyl aminopeptidase | −4.08 | −1.99 |
| PA4031 | ppa | inorganic pyrophosphatase | −2.28 | −3.22 |
| PA4067 | oprG | outer membrane protein OprG precursor | −5.22 | −3.38 |
| PA4141 | — | hypothetical protein | −9.76 | −3.11 |
| PA4210 | phzA1 | phenazine biosynthesis protein | −4.67 | −2.9 |
| PA4236 | katA | catalase | −7.22 | −1.82 |
| PA4463 | — | hypothetical protein | −4.32 | −2.69 |
| PA5171 | arcA | arginine deiminase | −5.67 | −1.85 |
| PA5253 | algP | alginate regulatory protein AlgP | −3.2 | −2.18 |

Table 6 shows genes that are down regulated in the P. aeruginosa PAO1 expressing synthetic RpoN but are absent in the P. aeruginosa ΔrpoN (PA06359). These are RpoN controlled genes. This result indicates that the transcription of these genes is antagonized by the synthetic RpoN in a wild type strain. The absence of these genes in the deletion mutant indicates that RpoN cannot be used to transcribe the genes.

TABLE 6

Genes down regulated in the P. aeruginosa PAO1 expressing synthetic RpoN but are absent in the P. aeruginosa ΔrpoN (PA06359).

| Locus | Gene name | Biological function | Fold Change |
|---|---|---|---|
| PA0298 | — | hypothetical protein | −2.93 |
| PA0302 | potG | polyamine transport protein | −2.42 |
| PA0446 | — | hypothetical protein | −2.08 |

TABLE 6-continued

Genes down regulated in the *P. aeruginosa* PA01 expressing synthetic RpoN but are absent in the *P. aeruginosa* ΔrpoN (PA06359).

| Locus | Gene name | Biological function | Fold Change |
|---|---|---|---|
| PA0547 | — | transcriptional regulator | −2.25 |
| PA0865 | hpd | 4-hydroxyphenylpyruvate dioxygenase | −12.08 |
| PA1073 | brad | branched-chain amino acid transport protein | −2.02 |
| PA1080 | flgE | flagellar hook protein | −2.59 |
| PA1094 | fliD | flagellar capping protein | −2.25 |
| PA1323 | — | hypothetical protein | −3.66 |
| PA1546 | hemN | coproporphyrinogen III oxidase | −2.56 |
| PA1784 | — | hypothetical protein | −2.65 |
| PA1874 | — | hypothetical protein | −3.94 |
| PA1888 | — | hypothetical protein | −3.54 |
| PA1939 | — | hypothetical protein | −4.36 |
| PA1967 | — | hypothetical protein | −2.36 |
| PA2110 | — | hypothetical protein | −5.18 |
| PA2111 | — | hypothetical protein | −8.75 |
| PA2444 | glyA2 | serine hydroxymethyltransferase | −8.72 |
| PA2446 | gcvH2 | glycine cleavage system protein H | −4.61 |
| PA2512 | antA | anthranilate dioxygenase large subunit | −2.36 |
| PA2553 | — | acyl-CoA thiolase | −6.6 |
| PA2815 | — | acyl-CoA dehydrogenase | −3.74 |
| PA3014 | faoA | multifunctional fatty acid oxidation complex subunit alpha | −2 |
| PA3188 | — | permease of ABC sugar transporter | −6.25 |
| PA3189 | — | permease of ABC sugar transporter | −3.39 |
| PA3190 | — | binding protein component of ABC sugar transporter | −7.22 |
| PA3250 | — | hypothetical protein | −2.33 |
| PA3336 | — | major facilitator superfamily (MFS) transporter | −2.54 |
| PA3337 | rfaD | ADP-L-glycero-D-mannoheptose 6-epimerase | −8.18 |
| PA3613 | — | hypothetical protein | −2.39 |
| PA3692 | — | Lipotoxon F | −6.27 |
| PA3784 | — | hypothetical protein | −3.18 |
| PA4132 | — | hypothetical protein | −6.41 |
| PA4205 | mexG | hypothetical protein | −5.33 |
| PA4306 | flp | Type IVb pilin | −6.25 |
| PA4328 | — | hypothetical protein | −2.51 |
| PA4500 | — | binding protein component of ABC transporter | −14.65 |
| PA4503 | — | permease of ABC transporter | −3.71 |
| PA4587 | ccpR | cytochrome c551 peroxidase precursor | −5.45 |
| PA4733 | ascB | acetyl-CoA synthetase | −2.56 |
| PA4735 | — | hypothetical protein | −2.08 |
| PA4824 | — | hypothetical protein | −36.69 |
| PA4825 | mgtA | Mg(2+) transport ATPase, P-type 2 | −88.95 |
| PA5167 | — | c4-dicarboxylate-binding protein | −5.39 |
| PA5417 | soxD | sarcosine oxidase delta subunit | −2.73 |
| PA5418 | soxA | sarcosine oxidase alpha subunit | −2.71 |
| PA5421 | fdhA | glutathione-independent formaldehyde dehydrogenase | −5.85 |

Table 7 shows genes that are upregulated in both the wild type and native RpoN deficient background *P. aeruginosa* strains. These results indicate that these genes are not controlled by RpoN directly.

TABLE 7

Genes that are up-regulated in both, *P. aeruginosa* PAO1 and *P. aeruginosa* ΔrpoN (PA06359) expressing synthetic RpoN. The underscore represents no gene name associated with the protein.

| Locus | Gene name | Biological function | PAO1 | PAO6359 |
|---|---|---|---|---|
| PA0578 | — | hypothetical protein | 5.18 | 3.30 |
| PA0579 | rpsU | 30S ribosomal protein S21 | 5.07 | 2.92 |
| PA0659 | — | hypothetical protein | 2.25 | 3.2 |
| PA0734 | — | hypothetical protein | 8.06 | 2.47 |
| PA0758 | — | hypothetical protein | 4.08 | 2.59 |
| PA1317 | cyoA | cytochrome o ubiquinol oxidase subunit II | 2.71 | 2.78 |
| PA1852 | — | hypothetical protein | 3.35 | 3.44 |
| PA3644 | lpxA | UDP-N-acetylglucosamine acyltransferase | 3.02 | 2 |
| PA3645 | fabZ | (3R)-hydroxymyristoyl-ACP dehydratase | 3.18 | 2.36 |
| PA3743 | trmD | tRNA (guanine-N(1)-)-methyltransferase | 6.43 | 2.81 |
| PA3744 | rimM | 16S rRNA-processing protein RimM | 5.11 | 3.22 |
| PA3815 | iscR | IscR | 2.33 | 2.37 |
| PA4115 | — | hypothetical protein | 3.06 | 3.86 |
| PA4433 | rplM | 50S ribosomal protein L13 | 4.03 | 2.69 |
| PA4563 | rpsT | 30S ribosomal protein S20 | 5.15 | 2.45 |
| PA4670 | prs | ribose-phosphate pyrophosphokinase | 3.81 | 2.2 |
| PA4782 | — | hypothetical protein | 2.15 | 3.01 |
| PA5316 | rpmB | 50S ribosomal protein L28 | 5.95 | 2.88 |
| PA5470 | — | peptide chain release factor-like protein | 6.87 | 4.02 |
| PA5471 | — | hypothetical protein | 6.16 | 3.51 |
| PA5570 | rpmH | 50S ribosomal protein L34 | 3.4 | 2.19 |

Table 8 shows genes that are down regulated in *P. aeruginosa* ΔrpoN (PA06359) as compared to wild type *P. aeruginosa*.

TABLE 8

Genes that are down regulated in *P. aeruginosa* ΔrpoN (PA06359) as compared to wild type *P. aeruginosa*.

| Locus | Gene name | Biological function | Fold Change |
|---|---|---|---|
| PA0102 | — | carbonic anhydrase | −2.11 |
| PA0200 | — | hypothetical protein | −2.24 |
| PA0459 | — | ClpA/B protease ATP binding subunit | −2.07 |
| PA0542 | — | hypothetical protein | −2.20 |
| PA0833 | — | hypothetical protein | −1.88 |
| PA0852 | cpbD | chitin-binding protein CbpD precursor | −2.15 |
| PA1215 | — | hypothetical protein | −2.09 |
| PA1216 | — | hypothetical protein | −5.82 |
| PA1217 | — | 2-isopropylmalate synthase | −3.19 |
| PA1342 | — | binding protein component of ABC transporter | −2.88 |
| PA1344 | — | short-chain dehydrogenase | −1.83 |
| PA1414 | — | hypothetical protein | −3.35 |
| PA1533 | — | hypothetical protein | −1.86 |
| PA1544 | anr | transcriptional regulator Anr | −2.13 |
| PA1588 | sucC | succinyl-CoA synthetase subunit beta | −2.04 |
| PA1589 | sucD | succinyl-CoA synthetase subunit alpha | −1.92 |
| PA1677 | — | hypothetical protein | −4.83 |
| PA1869 | — | acyl carrier protein | −3.48 |
| PA1901 | phzC2 | phenazine biosynthesis protein PhzC | −3.18 |
| PA1902 | phzE2 | phenazine biosynthesis protein PhzE | −2.77 |
| PA1903 | phzF2 | phenazine biosynthesis protein | −4.08 |
| PA1904 | phzG2 | pyridoxamine 5′-phosphate oxidase | −4.03 |
| PA1905 | phzC2 | phenazine biosynthesis protein PhzC | −4.89 |
| PA2008 | fahA | fumarylacetoacetase | −2.01 |
| PA2009 | hmgA | homogentisate 1,2-dioxygenase | −2.26 |
| PA2031 | — | hypothetical protein | −2.27 |
| PA2067 | — | hydrolase | −2.40 |
| PA2069 | — | carbamoyl transferase | −3.54 |
| PA2116 | — | hypothetical protein | −2.38 |

TABLE 8-continued

Genes that are down regulated in *P. aeruginosa* ΔrpoN (PA06359) as compared to wild type *P. aeruginosa*.

| Locus | Gene name | Biological function | Fold Change |
|---|---|---|---|
| PA2193 | hcnA | hydrogen cyanide synthase | −1.88 |
| PA2194 | hcnB | hydrogen cyanide synthase | −1.84 |
| PA2321 | — | gluconokinase | −2.48 |
| PA2412 | — | hypothetical protein | −1.96 |
| PA2604 | — | hypothetical protein | −2.09 |
| PA2619 | infA | translation initiation factor IF-1 | −1.93 |
| PA2623 | icd | isocitrate dehydrogenase | −1.85 |
| PA2624 | idh | isocitrate dehydrogenase | −2.60 |
| PA2634 | aceA | isocitrate lyase | −2.06 |
| PA2638 | nuoB | NADH dehydrogenase subunit B | −2.17 |
| PA2639 | nuoD | bifunctional NADH:ubiquinone oxidoreductase subunit C/D | 1.86 |
| PA2641 | nuoF | NADH dehydrogenase I subunit F | −2.40 |
| PA2642 | nuoG | NADH dehydrogenase subunit G | −2.19 |
| PA2644 | nuoI | NADH dehydrogenase subunit I | −1.95 |
| PA2647 | nuoL | NADH dehydrogenase subunit L | −2.39 |
| PA2740 | pheS | phenylalanyl-tRNA synthetase subunit alpha | −1.97 |
| PA2805 | — | hypothetical protein | −2.45 |
| PA3049 | rmf | ribosome modulation factor | −1.92 |
| PA3309 | — | hypothetical protein | −2.45 |
| PA3326 | — | ATP-dependent Clp protease proteolytic subunit | −2.97 |
| PA3477 | rhlR | transcriptional regulator RhlR | −2.81 |
| PA3479 | rhlA | rhamnosyltransferase chain A | −2.50 |
| PA3665 | — | hypothetical protein | −2.00 |
| PA3724 | lasB | elastase LasB | −3.23 |
| PA3831 | pepA | leucyl aminopeptidase | −1.99 |
| PA3880 | — | hypothetical protein | −1.97 |
| PA4031 | ppa | inorganic pyrophosphatase | −3.22 |
| PA4067 | oprG | outer membrane protein OprG precursor | −3.38 |
| PA4141 | — | hypothetical protein | −3.11 |
| PA4210 | phzA1 | phenazine biosynthesis protein | −2.90 |
| PA4211 | phzB1 | phenazine biosynthesis protein | −9.19 |
| PA4236 | katA | catalase | −1.82 |
| PA4348 | — | hypothetical protein | −2.22 |
| PA4463 | — | hypothetical protein | −2.69 |
| PA4602 | glyA3 | serine hydroxymethyltransferase | −2.22 |
| PA4872 | — | hypothetical protein | −1.86 |
| PA4922 | azu | azurin precursor | −2.91 |
| PA5170 | arcD | arginine/ornithine antiporter | −2.34 |
| PA5171 | arcA | arginine deiminase | −1.85 |
| PA5192 | pckA | phosphoenolpyruvate carboxykinase | −2.48 |
| PA5253 | algP | alginate regulatory protein AlgP | −2.18 |
| PA5445 | — | coenzyme A transferase | −2.07 |

CONCLUSION

Table 5 shows genes that are regulated by RpoN directly in *P. aeruginosa*. Table 6 shows genes that are regulated by RpoN but have promoters upstream of RpoN that are involved in their transcription. Table 7 shows genes that are not regulated by RpoN directly and are only turned on the absence of RpoN. Table 8 shows genes that are downregulated in the native RpoN deficient strain of *P. aeruginosa*. In summary, this example demonstrates identification of these genes and how they are regulated using the synthetic RpoN peptide described herein.

Example 5

Use of a Molecular Roadblock to Map the RpoN Regulon of *Pseudomonas aeruginosa* PAO1

This example demonstrates that an RpoN synthetic peptide can be used to map an RpoN regulon of a bacterium, and particularly the RpoN regulon of *Pseudomonas aeruginosa* PAO1.

Introduction

Gene expression in bacteria requires specialized proteins called sigma factors that direct the RNA polymerase (RNAP) to sites of transcription. Most sigma factors belong to the $\sigma^{70}$ family, which recognize a promoter at −10 base pairs upstream of the transcription start site. Whereas bacteria have multiple $\sigma^{70}$-type sigma factors, they normally only have one functional copy of the alternative sigma factor, $\sigma^{54}$ or RpoN. RpoN is an unusual sigma factor and initiates transcription from a highly conserved promoter located −24/−12 upstream of the transcriptional initiation site (1). Additional regulators called enhancer binding proteins or EBPs are required for activating transcription from RpoN promoters (2). The biological functions mediated by RpoN-dependent transcription are quite diverse and range from basic metabolism of various small organic molecules to complex adaptation responses such as biofilm formation (3-6). RpoN is a global transcriptional regulator and is necessary for full virulence in several human pathogens, including *Borrelia burgdorferi* (agent of Lyme disease), *Brucella abortus*, and *Pseudomonas aeruginosa* (7-9). Despite surmounting evidence of the importance of RpoN in processes such as bacterial pathogenesis and bioremediation, there is still no complete picture of the regulatory network governed by RpoN for any given bacterium.

The classic approach to define genes regulated by RpoN involves comparing and contrasting the transcriptomes between a wild-type bacterium and its rpoN-deficient equivalent. Although this direct comparison can provide a wealth of candidate genes that might be regulated by RpoN, it inherently has several critical shortcomings (FIG. 19). For example, genes and operons are typically expressed from more than one promoter, and although in an rpoN-deficient bacterium genes solely controlled by RpoN will not be expressed, a great number of genes that may possess RpoN promoters can still be transcribed from their $\sigma^{70}$-type promoters and as a result are erroneously classified as RpoN independent (10). Another weakness of the classic approach is the inability to observe instances of negative regulation or antagonistic relationships via RpoN. Like many other transcription factors, RpoN functions as a dual regulator. RpoN-mediated repression has been documented to be a naturally occurring method of gene regulation but the depth of this mode of regulation in bacteria is unknown and cannot be readily explored (11, 12). Lastly, the absence of a functional RpoN creates a significant burden on the cell. The catabolism of several commonly occurring organic and inorganic compounds is RpoN dependent, and removal of RpoN restricts the number of substrates that can be metabolized by the bacterium (13). Additionally, an rpoN-deficient bacterium cannot respond or adapt to environmental conditions in a native manner; because of this preexisting condition, it is not possible to observe RpoN-regulated networks in a temporal fashion, e.g., onset of oxygen starvation or biofilm maturation. Collectively, these traits yield a bacterial cell with a physiological and metabolic state that is grossly different than that of its RpoN proficient counterpart. This makes it difficult to discern genes that are regulated by RpoN or whose expression is altered due to pleiotropy associated with the rpoN deficiency.

Materials and Methods

Bacteria, Plasmids and Growth Conditions

Plasmids and oligonucleotides used in the study are given in Tables 9 and 10, respectively.

TABLE 9

Plasmids used in this example are given with relevant characteristics. Abbreviations for antibiotic selection: ampicillin (Am$^R$), kanamycin (Km$^R$) and gentamicin (Gm$^R$).

| Plasmids | Description | Source |
|---|---|---|
| pBBR1MCS-5 | Broad-host range cloning vector; Gm$^R$ | (38) (39) (39) (38) (38) |
| pTrc99a | General cloning expression vector; Am$^R$ | Pharmacia |
| pKH22 | pET-derived expression vector; Am$^R$ | (39) |
| pJ201:42178 | pUC ori, Km$^R$, codon optimized synthetic RpoN region III from *A. aerolicus* | DNA 2.0 |
| pBRL320 | lacI$^Q$-trc promoter of pTrc99a in pBBR1MCS5; Gm$^R$ | This example |
| pBRL327 | codon optimized synthetic RpoN region III from *A. aerolicus* in pKH22; Am$^R$ | This example |
| pBRL344 | same as pBRL320 but both EcoR I and Sac I restriction sites are absent from the MCS region of cloned pTrc99a fragment; Gm$^R$ | This example |
| pBRL348 | pBRL344, codon optimized synthetic RpoN region III from *A. aerolicus* | This example |
| pBRL349 | pBRL348, Y48A RpoN (synthetic) | This example |

TABLE 10

Oligonucleotides used in this example are given (5' to 3') and were purchased from Integrated DNA Technologies (Iowa, U.S.A.).

| Oligonucleotide | Sequence | SEQ ID NO: |
|---|---|---|
| BL330.f | cgtacggttgccaaggctcgtgagatgctgggtattccg | 10096 |
| BL330.r | cggaatacccagcatctcacgagccttggcaaccgtacg | 10097 |
| BL331.f | ggaaacagaccatgcaattccagctcggtacccggggatcc | 10098 |
| BL331.r | ggatccccgggtaccgagctggaattgcatggtctgtttcc | 10099 |
| BL343.f | ttaggcctgaatgccggtg | 10122 |
| BL343.r | atgtacgcagtgattgttaccg | 10123 |

Plasmids were maintained in *E. coli* Top10 (Invitrogen). *P. aeruginosa* studies were done using the strain PAO1 or the rpoN:Ω-Km insertion mutant PAO6359 (32). Bacteriological media was prepared from products of Becton, Dickinson and Company (BD). Bacteria were cultivated in BD Difco™ Lennox media (LB broth; 10 g L$^{-1}$ tryptone, 5 g L$^{-1}$ yeast extract, 5 g L$^{-1}$ NaCl) or M63 minimal media (37). BD Difco™ agar was added to a final concentration of 15 g L$^{-1}$ for solidifying bacteriological media. *P. aeruginosa* strains, PAO1 or PAO6359, were electroporated with plasmids as described (38). For gene expression in recombinant *P. aeruginosa* strains, isopropyl β-D-1-thiogalactopyranoside (IPTG) was used at a final concentration of either 1 or 2 mM depending on the experiment (see below). Antibiotics were used at the following concentrations: ampicillin, 100 mg L$^{-1}$ *E. coli*; kanamycin, 50 mg L$^{-1}$ *E. coli* or 500 mg L$^{-1}$ *P. aeruginosa*; gentamicin, 20 mg L$^{-1}$ *E. coli* or 30 mg L$^{-1}$ *P. aeruginosa*.

Construction of RpoN Molecular Roadblock

To construct a tightly regulated, IPTG-inducible expression vector for *P. aeruginosa*, the region encoding LacI$^Q$ and the trc-promoter of pTrc99a (Pharmacia Biotech, Sweden) was cloned into the Xba I and Sph I sites of the broad-host range plasmid pBBR1MCS-5 to yield pBRL320 (39). Next, the EcoR I and Sac I sites of the multiple cloning region of the inserted pTrc99a fragment in pBRL320 were removed via site-directed mutagenesis using Quikchange™ (Stratagene) and the oligonucleotides BL331.f/BL331.r (Table S2) to generate the plasmid pBRL344.

A gene encoding the last 60 amino acids of the RpoN of *A. aeolicus* was synthesized and codon optimized for expression in *E. coli* by DNA 2.0 (Menlo Park, Calif.). For cloning purposes, Nde I and Sac I restriction sites were engineered into the 5' and 3' ends, respectively, of the synthetic rpoN gene. The synthetic rpoN gene was then subcloned from pJ201:42178 into the Nde I/Sac I sites of the *E. coli* expression pET-vector pKH22 to give pBRL327 (40). The pBRL327 plasmid was then digested with Xba I and Sac I to liberate the synthetic rpoN gene with an upstream ribosome binding site. This fragment was cloned into the Xba I/Sac I sites of pBRL344 to yield pBRL348.

To generate an attenuated RpoN molecular roadblock, the tyrosine at position 48 was changed into alanine using Quikchange™ (Stratagene, Santa Clara, Calif.) with pBRL348 as the template and the oligonucleotides BL330.f/BL330.r (Table S2) (18). The resulting plasmid pBRL349 encodes for the Y48A RpoN molecular roadblock.

Analysis of Virulence Factors

*P. aeruginosa* strains, PAO1 or PAO6359, were transformed with either pBRL344 (empty plasmid), pBRL348 (RpoN*) or pBRL349 (Y48A RpoN*) plasmids (38). These recombinant strains were used for all virulence factor experiments.

Motility.

Motility of *P. aeruginosa* was assessed as described (37). Plates used in motility assays were supplemented with 2 mM IPTG. Single colonies of recombinant *P. aeruginosa* were stabbed onto (i) M63 minimal media supplemented with 0.5% Difco™ casamino acids, 0.2% glucose and 0.3% agar or (ii) LB with 0.3% agar. Motility plates were grown for 16 h at 37° C.

Hemolytic Activity.

Recombinant *P. aeruginosa* was patched onto LB-solid media supplemented with 5% sheep blood, 30 mg L$^{-1}$ gentamicin and 1 mM IPTG. Patched plates were grown at 37° C. for 16 h.

General Proteases.

To detect nonspecific protease activity, single colonies of recombinant *P. aeruginosa* were patched onto LB-solid media supplemented with 2% non-fat dry milk, 30 mg L$^{-1}$ gentamicin and 1 mM IPTG. Patched plates were grown at 37° C. for 16 h. Degradation of protein was determined by colony and/or halo formation.

Elastase.

Elastolytic activity was assayed by the breakdown of elastin-Congo red (41). In triplicate, recombinant P. aeruginosa PAO1 was grown in PTSB broth (50 g $L^{-1}$ Difco™ Peptone, 2.5 g $L^{-1}$ tryptic soy broth, 5 g $L^{-1}$ yeast extract) supplemented with 30 mg $L^{-1}$ gentamicin at 37° C. to an $OD_{600}$ of 0.15. At this time, IPTG was added to a final concentration of 2 mM, and the induced cultures were grown for an additional 5 h. After this 5 h incubation, cells were removed by centrifugation and passage through a 0.2 micron filter. Next, 1 mL of the cleared supernatant was added to 2 mL elastase reaction buffer (0.1 M Tris, pH 7.2, 1 mM $CaCl_2$, 10 g $L^{-1}$ elastin-Congo red). Reactions were incubated at 37° C. with gentle shaking for 7 h and subsequently centrifuged to remove insoluble elastin-Congo red. The absorbance of liberated Congo red in the supernatant was measured at 459 nm.

Pyoverdine.

Production of pyoverdine from P. aeruginosa in King's B medium (20 g $L^{-1}$ Difco™ bacteriological peptone, 1.5 g $L^{-1}$ $K_2HPO_4$, 1.5 g $L^{-1}$ $MgSO_4.7H_2O$, 1% v/v glycerol) was determined as follows. In triplicate, 2 mL of King B medium was inoculated with 0.5% of seed culture and then grown to an $OD_{600}$ of 0.3 at 37° C. with shaking at 250 rpm. IPTG was added to a final concentration of 2 mM, and the induced cultures were grown for an additional 16 h. After incubation, cells were cleared by passage through a 0.2 micron filter. The cleared filtrate was then assayed at 408 nm for pyoverdine.

Pyocyanin.

Production of pyocyanin from P. aeruginosa in LB was determined as described (42). In triplicate, 2 mL of LB was inoculated with 0.5% of seed culture and then grown to an $OD_{600}$ of 0.3 at 37° C. with shaking at 250 rpm. IPTG was added to a final concentration of 2 mM, and the induced cultures were grown for an additional 16 h. After incubation, cells were cleared by passage through a 0.2 micron filter, and the pyocyanin was extracted from 1.5 ml of the cell-free broth by the addition of 1 ml of chloroform. The resulting chloroform phase was then extracted with an equal volume of 0.2 M HCl, and the pink aqueous phase was assayed at 520 nm for pyocyanin.

RNA Isolation and Microarray Analysis

RNA isolation and microarray analysis were done in quadruplicate. Per replicate, a single clone of P. aeruginosa harboring either pBRL344 or pBRL348 was grown in 2 mL LB supplemented with 30 mg $L^{-1}$ gentamicin at 37° C., 250 rpm, for 16 h. This seed culture was then used (0.5% v/v) to inoculate 50 mL (in a 500-mL baffled shake flask) of LB supplemented with 30 mg $L^{-1}$ gentamicin. The inoculated shake-flask cultures were grown at 37° C., 250 rpm, until an $OD_{600}$ of 0.2, and then IPTG was added to a final concentration of 1 mM to induce expression of the RpoN molecular roadblock. The induced cells were grown for 2 h at which time 0.5 mL of culture was removed and added to 1 mL of RNAprotect® reagent. Total RNA was purified from the samples using the enzymatic lysis and proteinase K digestion method of Qiagen RNeasy with an on-column DNase digestion. Purified RNA samples were checked for DNA contamination by Polymerase Chain Reaction (PCR) with the primers BL343.f/BL343.r, which were designed to amplify the rplU gene (43) (Table S2). Purified RNA samples were also analyzed for quality using a Bioanalyzer (Agilent).

Microarray studies were carried out by the Microarray Core Facility (Upstate Medical University, Syracuse, N.Y.) using GeneChip® P. aeruginosa PAO1 Affymetrix arrays. Experiments were performed according to the Affymetrix GeneChip© Expression Analysis Technical Manual (Affymetrix publication 702232 Rev. 3) and published protocols established at SUNY Upstate (Syracuse, N.Y.) (44). For initial data processing, the Affymetrix software (MicroArray Suite 5.0; MASS) was used for quality control (Q/C) analysis, calculating the signal intensities from each perfect match prove on the arrays relative to the mismatch probe, and determining whether or not the gene was present in the sample. The RMA method was used to normalize the set of arrays in our screen (GeneTraffic software, Stratagene, La Jolla). The MultiExperiment viewer (MeV v4.6.2) was used for subsequent statistical analysis. To identify genes displaying a significant difference in intensities, a T-test between subjects was performed using p-values based on all permutations and overall alpha value fixed at 0.05. False discoveries were addressed using the standard Bonferroni correction. Microarray data was deposited in Gene Expression Omnibus and is accessible through GEO Series accession number GSE35632. (45).

Predictive Modeling of RpoN Promoters

Bacterial $\sigma^{54}$ promoters were identified genome-wide using a modified version of the PromScan Perl script (available at www.sigma54.ca/PromoterApp/Web/promscandata.pl), which was originally developed by Studholme (19). PromScan relies on a scoring algorithm that fits a position weighted matrix (PWM) to every location on both strands of a genome. The scoring function calculates the Kullback-Leibler divergence between the probability of observing a particular base from the matrix and the probability of that base occurring randomly in the genome. While the Kullback-Leibler divergence provides a measure of difference between two probability distributions, it has been shown that this property provides a reasonable estimate for binding energy contributions in the context of sequence-specific DNA binding proteins (2) and has been used extensively for this application. The original PromScan algorithm was further modified to output all hits within a genome, including intragenic hits, with a normalized score of 65 or higher. The Perl script was run on Windows using Strawberry Perl (free from strawberryperl.com/). The script used as inputs were the P. aeruginosa PAO1 DNA sequence file (FNA FASTA file from NCBI's FTP Genome Database (46)(46)(45)(45)(45), see External Database S1, FTP Folder found at ftp.ncbi.nlm.nih.gov/genomes/Bacteria/
Pseudomonas_aeruginosa_PAO1_uid57945/) and a $\sigma^{54}$ promoter position weighted matrix file that is derived from on 186 known $\sigma^{54}$ promoter sites (1). The script output consisting of a score, strand direction, and by location for each hit was captured in a text file and imported into a SQL server database (Microsoft SQL Server 2008 R2 Express free from www.microsoft.com/express/). The results were cross referenced using annotation data from PTT files and RNT files containing gene and RNA gene data respectively (also from NCBI's FTP Genome Database). The results are can be found below (External Database S2, P. aeruginosa PAO1 rpoN Score Data: found at www.sigma54.ca/PromoterApp/Web/setparameters.aspx?organism=NC_002516.2 &matrix=RPON.Matrix).

A C# program (www.sigma54.ca/source/DataExport/) was used to link hits with gene start sites on both the positive and reverse strands. A web interface was built to access and filter the data based on a variety of parameters including score and distance from the ORF. In addition, microarray data was imported into the server and linked to the hit and gene annotation data. A webpage displaying the microarray data was created with the ability to show the computationally predicted hits of both the coding and non-coding strands (External database S3, MicroArray Results with RpoN binding sites: found at www.sigma54.ca/PromoterApp/Web/PAmarray.aspx).

Results

Design and Construction of the RpoN Molecular Roadblock.

Figure 20:
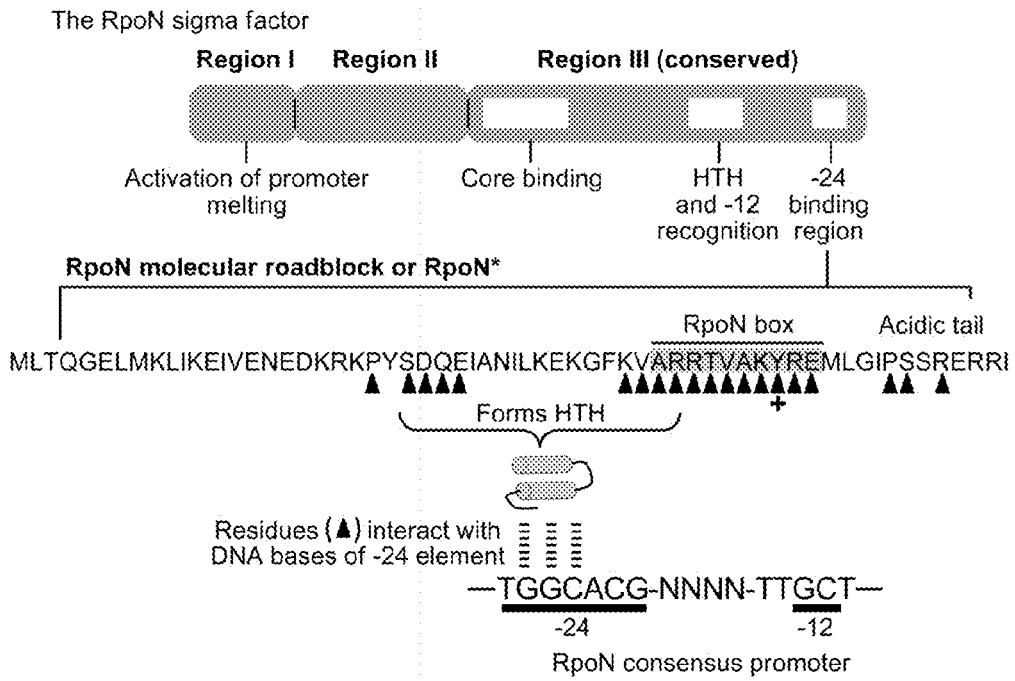
FIG. 20: Schematic illustration of the RpoN protein and the RpoN molecular roadblock. RpoN consists of three regions. Region III contains the highest degree of conservation among the three regions and is involved with binding to the −24/−12 conserved promoter elements. The RpoN* peptide comprises amino acids 376-400 of Region III of RpoN and contains amino acids that bind specifically to the −24 element of RpoN promoters. Changing the tyrosine residue (Y48, labeled as +) to alanine reduces the binding and transcriptional activity of RpoN. Region III is conserved among RpoN proteins in many bacteria.

Because of the central, crucial role played by RpoN in bacterial physiology and pathogenesis, and the inability of current methods to define regulons controlled by this sigma factor, it was necessary to develop a robust, simplistic tool for mapping bacterial RpoN regulatory networks. To this end, we exploited the unique binding properties of the RpoN protein for its cognate promoter. Unlike other sigma factors, RpoN can bind to its promoter without interacting with the RNA polymerase (RNAP), although this binding efficiency is 10-fold lower than that of the RpoN:RNAP complex (14). Importantly, RpoN proteins are highly conserved in their C-terminal DNA binding domains. This DNA binding domain of RpoN binds specifically to the −24 element of RpoN promoters with high affinity ($K_d$~114 nM) (15). Using this interaction to our advantage, a gene encoding a peptide resembling the last 60 amino acids of the RpoN from the thermophile *Aquifex aeolicus* was synthesized and codon-optimized for expression in the lab-prototype bacterium, *Escherichia coli* (FIG. 20). This short peptide, termed the RpoN molecular roadblock or RpoN*, will bind to the −24 element of RpoN promoters and antagonize transcription from these loci (FIG. 19). Unlike full-length RpoN, RpoN* cannot interact with native EBPs or RNAP and therefore minimally impacts the transcriptional machinery of the bacterial cell. For example, native sigma factors compete with each other for RNAP to initiate transcription, because RpoN* cannot interact with RNAP, it will not disturb the RNAP: sigma factor pools (16). When used with transcriptomic profiling and predictive modeling, the RpoN molecular roadblock can identify all sites of RpoN regulation, including points of regulation that could not be visualized before such as genes possessing multiple promoters and/or under negative control by RpoN.

The RpoN Molecular Roadblock Inhibits Motility and Production of Virulence Factors of *P. aeruginosa*.

Figure 21:
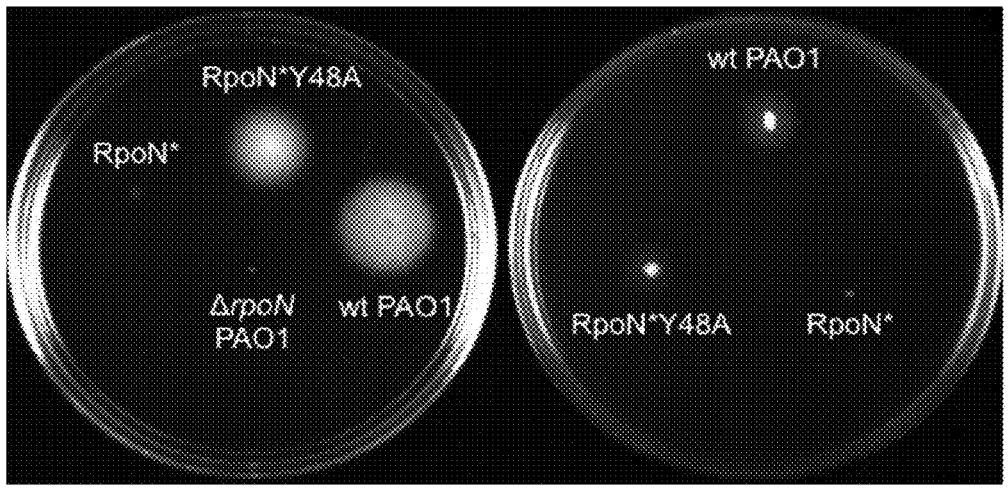
FIG. 21: Expression of RpoN molecular roadblock inhibits both swarming (left) and twitching (right) motility of *P. aeruginosa* PAO1. Colonies of recombinant *P. aeruginosa* PAO1 harboring either empty plasmid, RpoN* or Y48A RpoN* were stabbed onto either i) M63 minimal media supplemented with 0.2% glucose, 0.5% casamino acids and 0.3% agar (swarming) or ii) thin-layer LB plates in polystyrene petri dishes (twitching). Plates were supplemented with 2 mM IPTG to induce expression of recombinant proteins and grown for 16 h at 37° C. Swarming motility of recombinant rpoN-deficient *P. aeruginosa* PAO1 (PA06359/pBRL344) was done for comparison.
Figure 22:
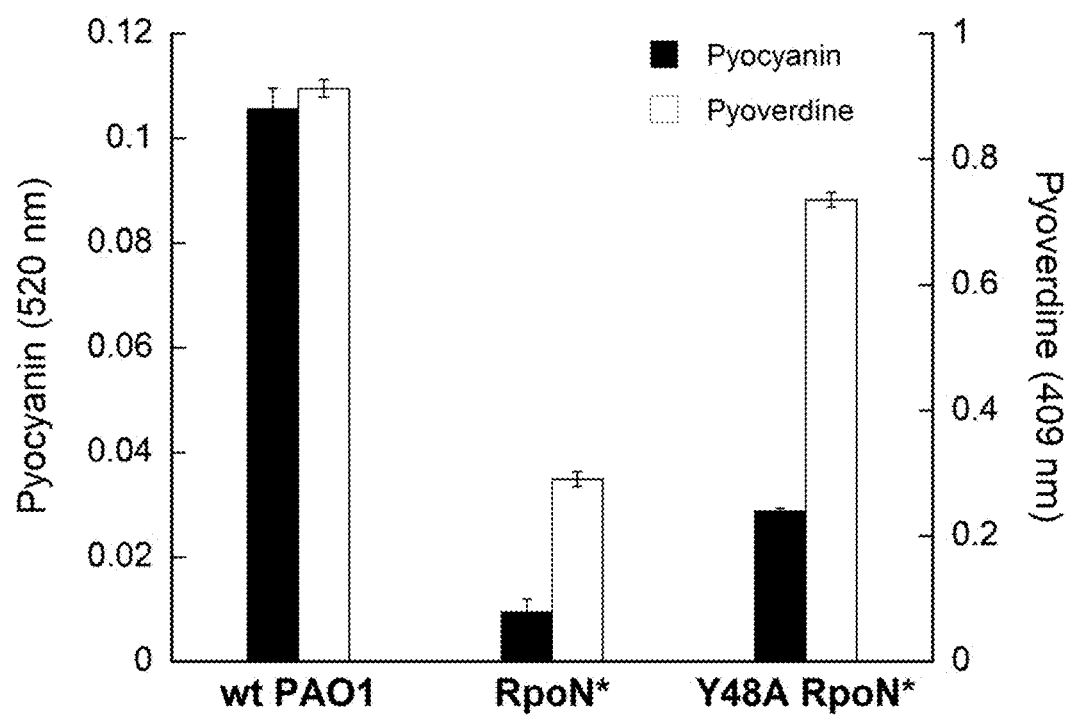
FIG. 22: Expression of RpoN molecular roadblock reduces pyocyanin and pyoverdine production from *P. aeruginosa* PAO1 grown on LB. Recombinant *P. aeruginosa* PAO1 harboring either empty plasmid (wt PAO1), RpoN* or Y48A RpoN* were evaluated for the production of pyocyanin and pyoverdine in LB. Standard error bars are shown.
Figure 23:
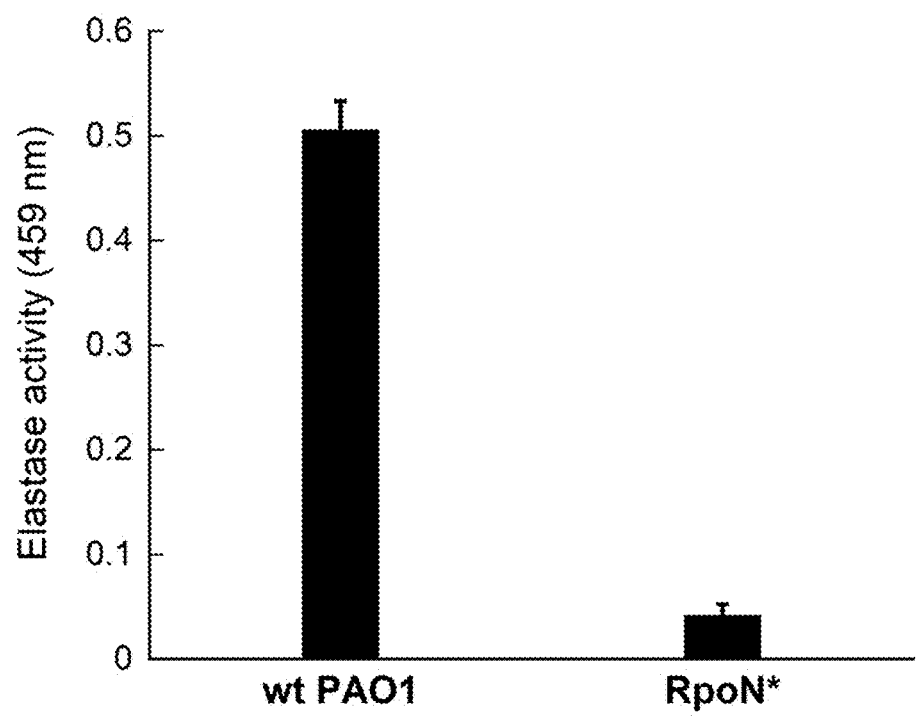
FIG. 23: Expression of RpoN molecular roadblock reduced the production of elastase from *P. aeruginosa* PAO1 grown on PTSB. Recombinant *P. aeruginosa* PAO1 harboring either empty plasmid (wt PAO1) or RpoN* were grown on PTSB for 7.5 h at 37° C. Cells were removed from the broth, and the resulting cell-free samples were assayed for the breakdown of elastin-Congo red. Standard error bars are shown.
Figure 24:
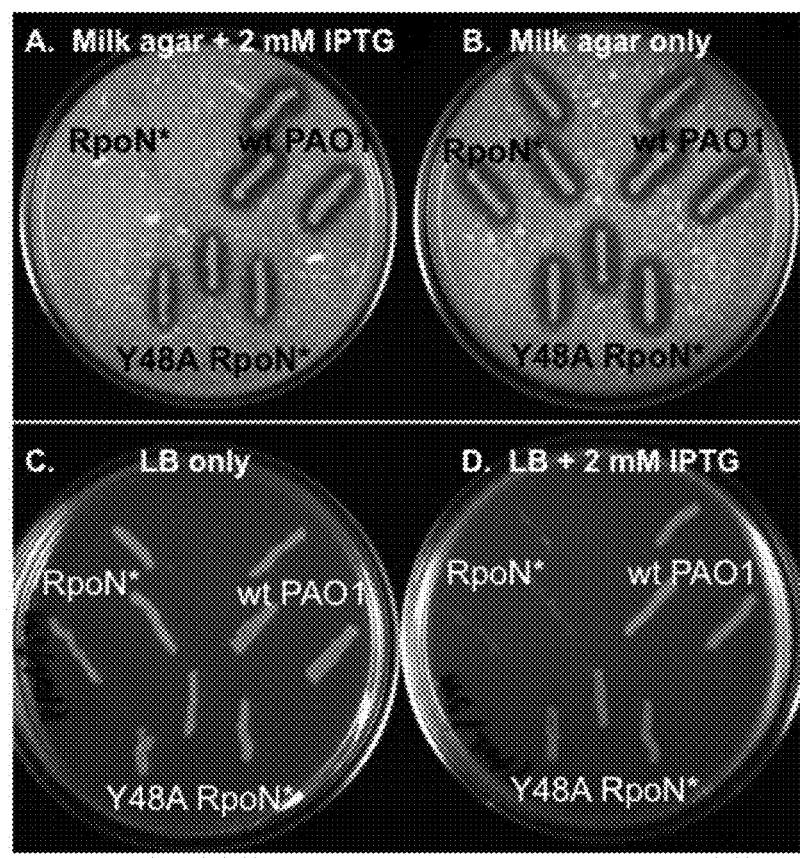
FIG. 24: Expression of RpoN molecular roadblock inhibits growth of *P. aeruginosa* PAO1 on rich media, including milk agar (top) and LB (bottom). Recombinant *P. aeruginosa* PAO1 harboring either empty plasmid (wt PAO1), RpoN* or Y48A* RpoN were patched onto rich-solid media and growth was assessed after 16 h at 37° C.
Figure 25:
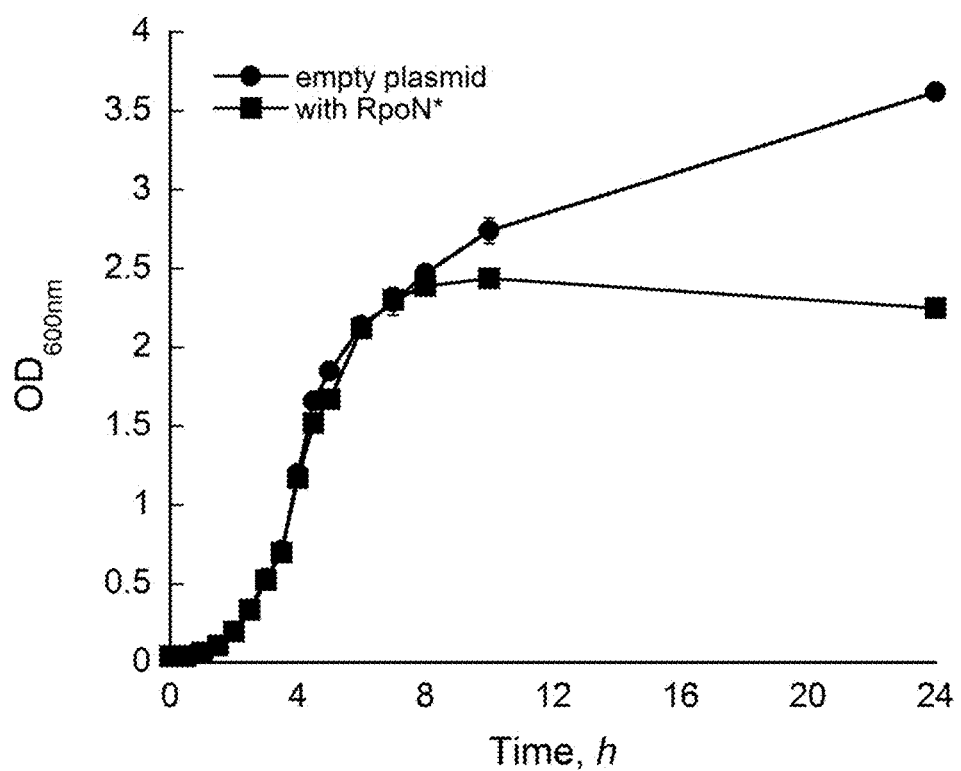
FIG. 25: Expression of RpoN molecular roadblock inhibited the growth of *P. aeruginosa* PAO1 following 3 h post induction. Recombinant *P. aeruginosa* PAO1 harboring either empty plasmid or RpoN* were grown in LB at 37° C., 250 rpm. Cultures were induced at an $OD_{600nm}$ of 0.5 with 1 mM IPTG. As shown, within 3 h post induction, RpoN* reduced the growth of *P. aeruginosa* PAO1. All results shown are the average values from triplicate samples. Standard error bars are shown.

To test the functionality of the RpoN molecular roadblock, it was used to antagonize known RpoN-mediated responses in the opportunistic and model pathogen *P. aeruginosa* PAO1. RpoN* was cloned into a broad-host range plasmid under the control of an inducible trc-promoter to enable precise timing of RpoN* expression. Introduction of the plasmid-based RpoN* into *P. aeruginosa* PAO1 significantly impeded the organism's motility on semisolid media (FIG. 21), which is a biological function that requires RpoN-mediated transcription (17). The RpoN molecular roadblock also decreased the production of the siderophore pyoverdine, phenazine compounds such as pyocyanin, and the major extracellular protease, elastase (FIGS. 22 and 23). Expression of RpoN* prevented the growth of the bacterium on a wide range of rich media, and alleviation of this growth inhibition could only be achieved with the addition of free amino acids (FIG. 24). To gain insight into whether these phenotypes were a result of RpoN* binding, the tyrosine residue (Y48) located within the RpoN box of RpoN* was replaced by alanine using site-directed mutagenesis. As shown previously for full-length RpoN, this tyrosine-alanine mutation reduces the binding and transcriptional activation efficacy of the RpoN protein (18). As expected, the Y48A RpoN* peptide generated similar traits to that of wild-type *P. aeruginosa* PAO1 (FIGS. 21, 23, and 24). The expression of RpoN* did not slow down the growth rate of *P. aeruginosa* in liquid culture until ~3 hours post induction (FIG. 25). It was initially suspected that the reduction of these virulence factors and growth rate was due to a pleiotropic and toxic effect of the RpoN molecular roadblock via non-specific DNA binding. However, examination of the transcriptome of *P. aeruginosa* expressing the RpoN molecular roadblock revealed a completely different story.

Mapping the RpoN Regulon of *P. aeruginosa*.

Having evidence that expression of the RpoN molecular roadblock could inhibit RpoN-related functions, we next attempted to redefine the RpoN regulon for *P. aeruginosa* PAO1 using a combination of predictive bioinformatics and microarray analysis. Putative binding sites for the RpoN molecular roadblock in *P. aeruginosa* PAO1 were identified in silico using an algorithm based on the PromScan software and an RpoN promoter positional weighted matrix (1, 19). This algorithm has been applied to ascertain putative RpoN promoters from over 60 sequenced genomes covering a wider range of bacterial phyla (data available at www.sigma54.ca).

Figure 26:
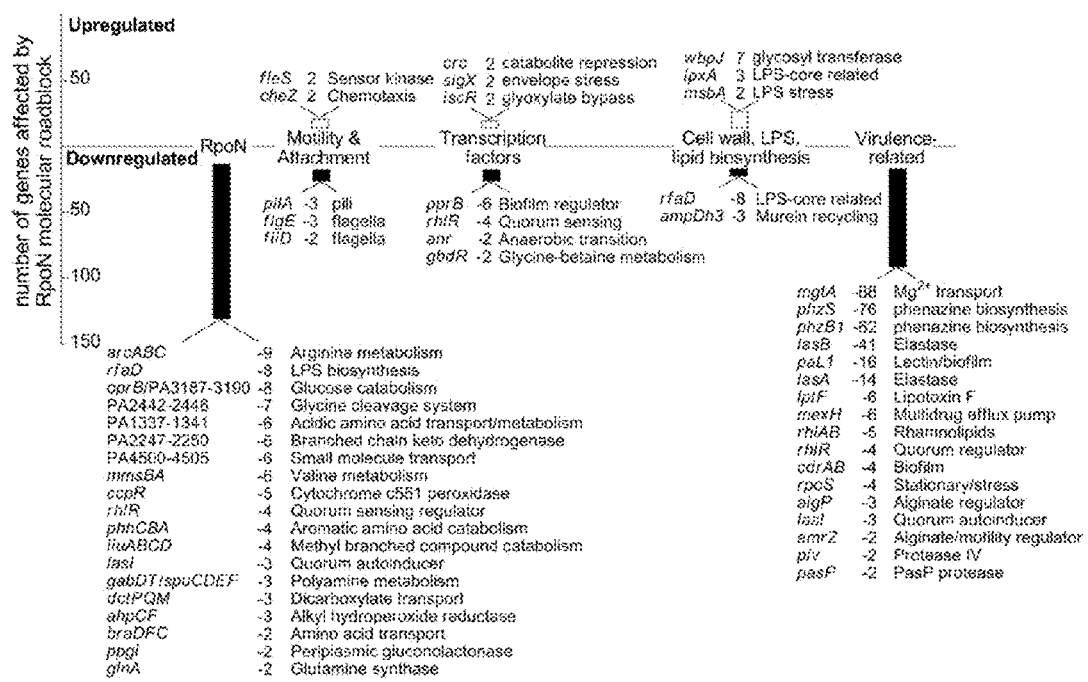
FIG. 26: Expression of the RpoN molecular roadblock altered the transcription of over 700 genes. The majority of downregulated genes possessed high-scoring putative RpoN binding sites and were found to be involved in metabolism. The RpoN molecular roadblock had a negative effect on the transcription of quorum-related genes, e.g., virulence factors, and other key transcriptional regulators such as the anaerobic transition regulator, anr. Note that the hypothetical (~250 total) and ribosomal (~70) genes were excluded from the above figure.

Microarray experiments were done in quadruplicate using Affymetrix GeneChips™. Cells of *P. aeruginosa* PAO1 harboring plasmids capable of inducible RpoN* expression or the empty vector equivalent were grown in rich media and upon entering mid-exponential growth, expression of RpoN* was induced. At two hours post induction, total RNA was isolated and subjected to transcriptiomic analysis. The two-hour time point was chosen, because it gave sufficient time for recombinant RpoN* to be expressed and saturate RpoN promoters. Notably, we observed no difference in growth rates between *P. aeruginosa* with and without RpoN* but there was a clear phenotypic difference based on the presence and absence of the blue-chromophore pyocyanin in cultures with empty plasmid as compared to cells expressing RpoN*. A total of ~700 genes were found to be differentially expressed at least 2-fold in the presence of the RpoN molecular roadblock. The majority of these genes (>400) were downregulated whereas those involved in lipopolysaccharide and ribosomal biosynthesis constituted the preponderance of upregulated genes. After crosschecking downregulated genes with their predicted RpoN promoters, a total of 150 genes were classified as being under the control of RpoN and can be broadly divided into proteins involved in metabolism, stress/survival, or cell signaling (FIG. 26).

RpoN Network in General Metabolism.

Figure 27:
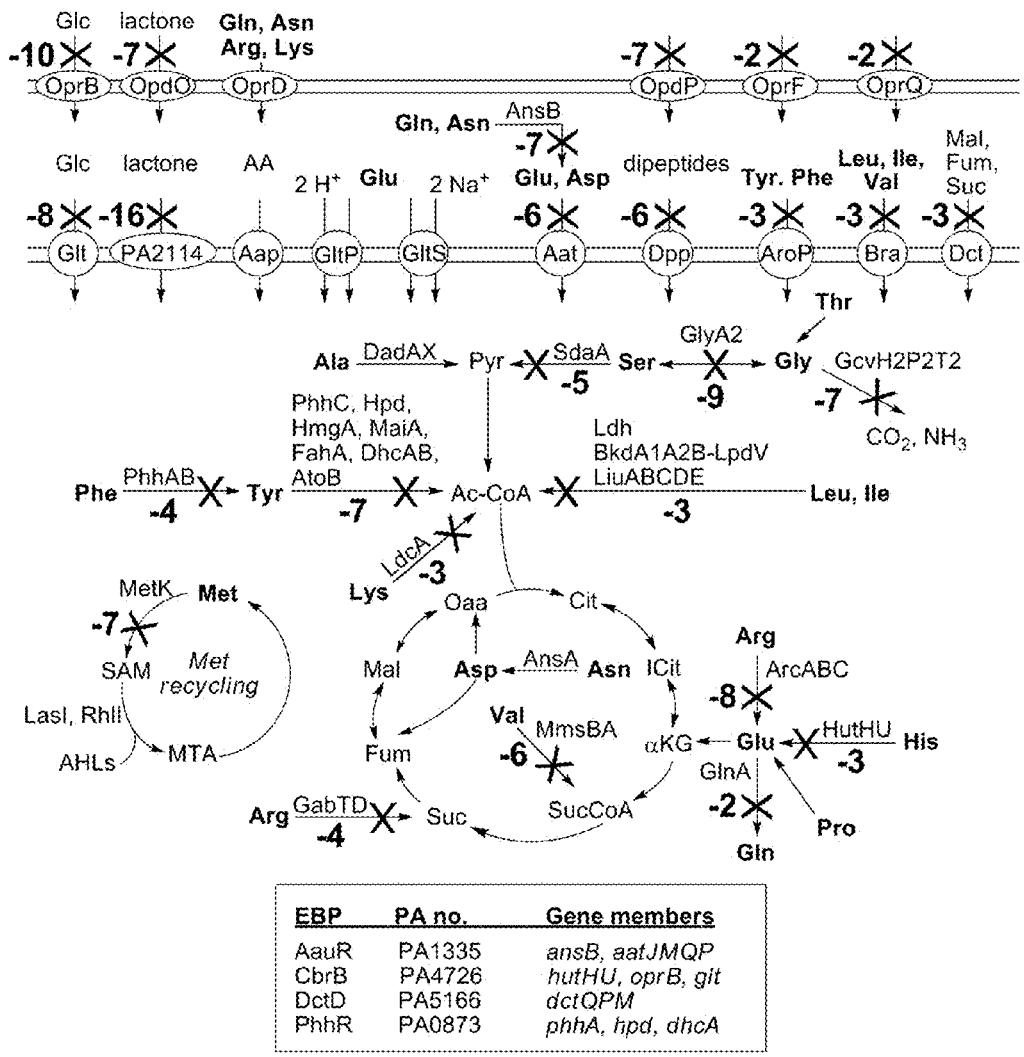
FIG. 27: RpoN controls multiple facets of carbon and nitrogen metabolism in *P. aeruginosa*. Expression of the RpoN molecular roadblock downregulated transcription of genes involved in assimilating diverse carbon and nitrogen sources. Bold numbers indicate fold down regulation of genes encoding proteins and "X" indicates potential blockage of transport or catabolic ability due to the repression of genes encoding these proteins via the RpoN molecular roadblock. Several of these metabolic pathways were previously observed to be under the control of RpoN EBPs, including AauR, PhhR, DctD and CbrB. The microarray data generated in our study supports these earlier findings but also suggests that RpoN regulates single carbon metabolism (glycine cleavage system and SAM biosynthesis), hexose transport and the catabolism of branched-chain amino acids.

Transcription of genes involved in the consumption of sugars, amino acids and dicarboxylates was repressed under expression of the RpoN molecular roadblock (FIG. 27). This data was consistent with prior experimental evidence of RpoN and its cognate EBPs functioning in carbon metabolism of *Pseudomonas* spp. A classic example of this is the RpoN regulation of the glutamine synthase gene, glnA, which requires the EBP NtrC, and is activated under nitrogen limitation (20). As expected, transcription of the glnA locus declined 2-fold as a result of expression of RpoN*. In another example, the EBP PhhR is necessary for aromatic amino acid catabolism, and genes previously cataloged into the PhhR regulon were downregulated as a result of RpoN* expression (21). The EBP AauR regulates transport of acidic amino acids, and as anticipated, RpoN* repressed transcription of AauR-controlled genes (22). The more global acting EBP CbrB functions in the assimilation of a wide variety of compounds, including several common amino acids (alanine, arginine, and histidine) (23). It is also known that AcbrB *P. aeruginosa* is impaired in the use glucose and mannitol as sole carbon sources but the reason for this trait has remained unclear (24). Based on our predictive bioinformatics, the sugar-specific outer membrane porin, OprB, and the hexose transporter, GlcKGF, have high-scoring putative RpoN promoters, and their transcription decreased by 8-fold when the RpoN molecular roadblock was expressed. Transcription of these loci appeared to be RpoN-dependent and a key determinant in sugar utilization by *Pseudomonas*, thus providing a probable explanation for the growth limitation observed with the cbrB null mutation. Recently, genes encoding a dicarboxylate transport system, DctPQM, were found to be under the control of the EBP DctD, and this regulation was confirmed by expression of RpoN*, which downregulated the transcription of the dctPQM operon by 3-fold (25). In addition to targeting and identifying genes regulated by RpoN and known EBPs, several new metabolic conversions regulated by RpoN were discovered in this example. Single carbon metabolism via the glycine cleavage system, the recycling of S-adenosylmethionine, breakdown of branched chain amino acids and the transcription of the terminal pathway for arginine and polyamine degradation, the gabTD genes, were found to be RpoN-dependent. Interestingly, transcriptional regulator(s) of the gabTD operon have not been identified but direct control via RpoN coincides with previously observed RpoN regulation of other genes involved in arginine and polyamine utilization (26). These findings greatly expand our knowledge of RpoN regulation and suggest that RpoN-mediated transcription is widespread across all points of bacterial metabolism.

We also observed that RpoN regulates transcription of several genes whose products are associated with cell stress and survival (12, 27). One of the more interesting members of this group was the rfaD gene, which encodes a required enzyme for the biosynthesis of core lipopolysaccharide (LPS). The rfaD gene has a predicted RpoN promoter of a score of 81 and has been shown to be regulated by RpoN and the EBP NtrC in the human-related pathogen *Vibrio vulnificus* (28). Transcription of rfaD declined 8-fold due to RpoN* expression, and this drop in expression of rfaD was associated with an increase in transcription for several LPS biosynthesis genes as exemplified by the LPS-stress protein, MsbA. Some other notable genes with observed RpoN regulation identified by our study include mgtA ($Mg^{2+}$ transport), rmf (ribosome modulation factor), rpoS, ccpR (cytochrome c551 peroxidase), and PA3309 (universal stress protein).

RpoN in Cell Signaling of *P. Aeruginosa*.

RpoN* also negatively regulated quorum sensing (QS) in *P. aeruginosa*. Cell signaling in *P. aeruginosa* consists of three interconnecting networks: the two homoserine lactone-responsive regulators, RhlR and LasR, and signaling via 2-alkyl-4-quinolones or PQS (29, 30). Expression of the RpoN molecular roadblock significantly reduced the transcription of two major QS proteins RhlR and the autoinducer synthase LasI. This antagonistic action at the rhlR/lasI loci led to downregulation of >70 genes suspected to be regulated by RhlR/LasR signaling, including the virulence factors elastase, protease IV, esterase, rhamnolipids, and transcriptional regulators, e.g., RpoS and PprB (31). Because the rhlR/lasI loci can be transcribed from multiple promoters, the direct antagonistic actions of RpoN on these genes cannot be observed by simply comparing transcriptome data between wild-type and rpoN-deficient *P. aeruginosa*. Higher levels of QS molecules have been observed in rpoN-deficient *P. aeruginosa*, which supports the microarray results generated by RpoN* (32). Together, they suggest that native RpoN might be a natural negative regulator of QS in *P. aeruginosa*. It was also observed that the PQS signaling system was transcriptionally intact in *P. aeruginosa* expressing the RpoN molecular roadblock, but its end product pyocyanin was greatly reduced. The microarray results showed that the genes required for phenazine biosynthesis were down by 8-fold in the presence of RpoN*; both phenazine biosynthetic clusters possess high-scoring putative RpoN promoters. Overall, the decreased production of pyocyanin can be attributed to the downregulation of genes involved in phenazine biosynthesis and elevated levels of intracellular tyrosine, which limits precursor availability for compounds derived from the shikimic acid pathway, including phenazines (33).

Because native RpoN can bind to its cognate promoter without interacting with RNA polymerase, it serves as a repressor of transcription for genes regulated by multiple promoters (12). This type of regulation is impossible to examine with rpoN-deficient strains alone. To discover loci that are under the control of RpoN and may possess multiple promoters, transcriptomics were compared between rpoN-deficient *P. aeruginosa* PAO1 expressing either RpoN* or the empty vector equivalent. The results of these microarrays identified several genes (~30) that were antagonistically regulated by RpoN* (FIG. 28). For example, isocitrate lyase activity has been found to be negatively regulated by RpoN in *P. aeruginosa*, and the isocitrate lyase gene (aceA), was observed to be downregulated by 2-fold in the presence of the RpoN molecular roadblock (34). Another key antagonistic interaction that was discovered involves the anr gene, which encodes a regulator of anaerobic metabolism. The anr gene is known to possess an RpoN promoter but was previously thought to be RpoN-independent (10). However, its transcription decreased 2-fold as a result of expression of RpoN*, suggesting the specific antagonistic nature of RpoN on expression of anr. Indeed, several gene members of the Anr regulon were predicted to have strong probable RpoN promoters and downregulated by RpoN* expression, including genes encoding the hydrogen cyanide synthase (hcnABC) and the arginine deaminase pathway (arcABC) (35). This suggests that RpoN might aid in coordinating overall metabolism at the onset of anaerobic transition.

Discussion

Use of the RpoN molecular roadblock in *P. aeruginosa* PAO1 readily identified hundreds of genes under the control of RpoN, thereby providing an accurate and temporal snapshot of RpoN regulation within the cell. However, there were some unexpected results. It was originally speculated that genes involved in the biosynthesis of flagella would be noticeably downregulated, because these genes are known to be transcribed by RpoN in *P. aeruginosa*. Despite the few flagella genes that were downregulated by the RpoN molecular roadblock, the majority remained unchanged. It was also noticed that the cognate sensor kinase, FleS, for the EBP FleR was upregulated. We propose that the flagella loci may represent a sort of 'hot' site for RpoN regulation in which the native RpoN:RNAP complex is effectively able to out compete the RpoN roadblock for gene activation. As previously stated, the RpoN:RNAP holoenzyme has stronger affinity for the RpoN promoter than that of RpoN alone (>10-fold difference) and this phenomenon would explain why certain RpoN-controlled genes were undetected with the RpoN molecular roadblock. In contrast, detection of RpoN regulation at some of these 'hot' loci was due to a probable titration effect caused by the RpoN molecular roadblock. Because of the limited availability of RpoN:RNAP holoezymes, RpoN* inhibition cannot be overridden at all loci with RpoN promoters.

Similarly, the metabolism of certain amino acids is under RpoN regulation, but the RpoN molecular roadblock did not affect the transcription of the catabolic genes for some of these compounds. For example, P. aeruginosa prefers to consume proline, alanine, arginine and glutamate (36). The microarray results from our study support this trend. Genes necessary for the degradation of histidine, branched chain and aromatic amino acids were significantly downregulated whereas gene expression was unchanged for the catabolism of more favorable substrates, i.e., proline, alanine and arginine. The metabolism of these three amino acids requires RpoN and the EBP CbrB but is also regulated by other transcription factors. Transcriptional activation by these other regulators and native RpoN:RNAP most likely weakened the inhibitory effect of RpoN*. More sensitive detection methods such as qPCR can be used to measure transcriptional changes at suspected RpoN control points where competition between the RpoN molecular roadblock and the native RpoN:RNAP is occurring.

This example describes the development and successful application of a DNA-binding protein (RpoN molecular roadblock) that specifically targets the −24 element of the promoter of the global transcriptional regulator RpoN to interrogate and redefine the RpoN regulon of P. aeruginosa. The RpoN molecular roadblock is a compelling tool that will allow researchers to define the RpoN regulon of any bacterium. The −24 element of an RpoN promoter is comprised of only seven nucleotides, so it was reasonable to suspect that this DNA binding protein or RpoN molecular roadblock would interact with this motif throughout the genome of any given bacterium. However, expression of the RpoN molecular roadblock in P. aeruginosa targeted and affected transcription of only genes under RpoN control. We did not observe any random perturbations in transcription for genes that could not be linked to RpoN regulation. The RpoN molecular roadblock does not interact with the −12 element of RpoN promoters and has conclusively been shown to bind specifically to the consensus sequence of the −24 element. How much nucleotide variation is allowed before the RpoN molecular roadblock no longer interacts with the −24 element? The answer to this question will not only define how RpoN mediated transcription depends on the magnitude of the interaction between RpoN and the −24 element, but will allow us to strengthen the substrate specificity of RpoN molecular roadblock.

Due to the universal nature of RpoN transcription, the RpoN molecular roadblock can be used across numerous bacterial species to completely map out their respective RpoN regulatory networks. The inducible expression of RpoN* allows for the first time the ability to assess RpoN regulation at any instant during a bacterium's life cycle. It is now possible to measure RpoN regulation in a temporal manner, which could not be ascertained before, and therefore will allow us to discover RpoN-mediated responses that occur during biofilm formation or that are necessary for infection in patients with cystic fibrosis. The RpoN molecular roadblock can be employed in bacteria in which it is not possible to generate rpoN-deficient strains, and combined with transcriptomic studies as outlined here, will shed some light on the essentiality of RpoN regulation within these unusual microorganisms. Microarray analysis illustrated the use of the RpoN molecular roadblock for defining the RpoN regulon of P. aeruginosa. RpoN molecular roadblock binding to the −24 RpoN promoter element resulted in interference with transcription from RpoN promoters and all sites of RpoN control were readily identified. Interestingly, RpoN was found to control a genetic network that was responsible for processing a wealth of environmental responses and information. Expression of the RpoN molecular roadblock under different conditions and stresses in P. aeruginosa will enable us to completely define the genetic network for this global transcriptional regulator.

REFERENCES AND NOTES

1. Barrios H, Valderrama B, & Morett E (1999) Compilation and analysis of sigma(54)-dependent promoter sequences. *Nucleic acids research* 27(22):4305-4313.
2. Chen B, et al. (2007) ATP ground- and transition states of bacterial enhancer binding AAA+ ATPases support complex formation with their target protein, sigma54. *Structure* 15(4):429-440.
3. Totten P A, Lara J C, & Lory S (1990) The rpoN gene product of *Pseudomonas aeruginosa* is required for expression of diverse genes, including the flagellin gene. *Journal of bacteriology* 172(1):389-396.
4. Köhler T, Harayama S, Ramos J L, & Timmis K N (1989) Involvement of *Pseudomonas putida* RpoN sigma factor in regulation of various metabolic functions. *Journal of bacteriology* 171(8):4326-4333.
5. Giglio K M, Eisenstatt J, & Garza A G (2010) Identification of enhancer binding proteins important for *Myxococcus xanthus* development. *Journal of bacteriology* 192:360-364.
6. Jones J, Studholme D J, Knight C G, & Preston G M (2007) Integrated bioinformatic and phenotypic analysis of RpoN-dependent traits in the plant growth-promoting bacterium *Pseudomonas fluorescens* SBW25. *Environmental microbiology* 9(12):3046-3064.
7. Fisher M A, et al. (2005) *Borrelia burgdorferi* sigma54 is required for mammalian infection and vector transmission but not for tick colonization. *Proceedings of the National Academy of Sciences of the United States of America* 102 (14):5162-5167.
8. Iannino F, Ugalde R A, & Inon de Iannino N (2008) Characterization of *Brucella abortus* sigma factor sigma54 (rpoN): genetic complementation of *Sinorhizobium meliloti* ntrA mutant. *Microb Pathog* 45(5-6):394-402.
9. Hendrickson E L, Plotnikova J, Mahajan-Miklos S, Rahme L G, & Ausubel F M (2001) Differential roles of the *Pseudomonas aeruginosa* PA14 rpoN gene in pathogenicity in plants, nematodes, insects, and mice. *Journal of bacteriology* 183(24):7126-7134.
10. Savioz A, Zimmermann A, & Haas D (1993) *Pseudomonas aeruginosa* promoters which contain a conserved GG-N10-GC motif but appear to be RpoN-independent. *Mol Gen Genet.* 238(1-2):74-80.
11. Boucher J C, Schurr M J, & Deretic V (2000) Dual regulation of mucoidy in *Pseudomonas aeruginosa* and sigma factor antagonism. *Molecular microbiology* 36(2): 341-351.
12. Dong T, Yu R, & Schellhorn H (2011) Antagonistic regulation of motility and transcriptome expression by RpoN and RpoS in *Escherichia coli*. *Molecular microbiology* 79(2):375-386.
13. Reitzer L & Schneider B L (2001) Metabolic context and possible physiological themes of sigma(54)-dependent genes in *Escherichia coli*. *Microbiology and molecular biology reviews: MMBR* 65(3):422-444.
14. Merrick M (1993) In a class of its own—the RNA polymerase sigma factor σ54 (σN). *Molecular microbiology* 10(5):903-909.

15. Doucleff M, Pelton J G, Lee P S, Nixon B T, & Wemmer D E (2007) Structural basis of DNA recognition by the alternative sigma-factor, sigma54. *Journal of molecular biology* 369(4):1070-1078.
16. Jishage M, Kvint K, Shingler V, & Nystrom T (2002) Regulation of sigma factor competition by the alarmone ppGpp. *Genes & development* 16(10):1260-1270.
17. Dasgupta N, et al. (2003) A four-tiered transcriptional regulatory circuit controls flagellar biogenesis in *Pseudomonas aeruginosa. Molecular microbiology* 50(3): 809-824.
18. Wang L & Gralla J D (2001) Roles for the C-terminal region of sigma 54 in transcriptional silencing and DNA binding. *The Journal of biological chemistry* 276(12): 8979-8986.
19. Studholme D J, Buck M, & Nixon T (2000) Identification of potential sigma(N)-dependent promoters in bacterial genomes. *Microbiology* 146 Pt 12:3021-3023.
20. Magasanik B (1993) The regulation of nitrogen utilization in enteric bacteria. *J Cell Biochem* 51(1):34-40.
21. Palmer G C, Palmer K L, Jorth P A, & Whiteley M (2010) Characterization of the *Pseudomonas aeruginosa* transcriptional response to phenylalanine and tyrosine. *Journal of bacteriology* 192(11):2722-2728.
22. Singh B & Röhm K (2008) Characterization of a *Pseudomonas putida* ABC transporter (AatJMQP) required for acidic amino acid uptake: biochemical properties and regulation by the Aau two-component system. *Microbiology* 154(3):797-809.
23. Nishiyo T, Haas D, & Itoh Y (2001) The CbrA-CbrB two-component regulatory system controls the utilization of multiple carbon and nitrogen sources in *Pseudomonas aeruginosa. Molecular microbiology* 40(4):917-931.
24. Li W & Lu C D (2007) Regulation of carbon and nitrogen utilization by CbrAB and NtrBC two-component systems in *Pseudomonas aeruginosa. Journal of bacteriology* 189 (15):5413-5420.
25. Valentini M, Storelli N, & Lapouge K (2011) Identification of C(4)-dicarboxylate transport systems in *Pseudomonas aeruginosa* PAO1. *Journal of bacteriology* 193(17): 4307-4316.
26. Lu C D, Itoh Y, Nakada Y, & Jiang Y (2002) Functional analysis and regulation of the divergent spuABCDEFGH-spuI operons for polyamine uptake and utilization in *Pseudomonas aeruginosa* PAO1. *Journal of bacteriology* 184(14):3765-3773.
27. Hwang S, Jeon B, Yun J, & Ryu S (2011) Roles of RpoN in the resistance of *Campylobacter jejuni* under various stress conditions. *BMC microbiology* 11:207.
28. Kim H, Lee M, Chun S, Park S, & Lee K (2007) Role of NtrC in biofilm formation via controlling expression of the gene encoding an ADP-glycero-manno-heptose-6-epimerase in the pathogenic bacterium, *Vibrio vulnificus. Molecular microbiology* 63(2):559-574.
29. Dubern J F & Diggle S P (2008) Quorum sensing by 2-alkyl-4-quinolones in *Pseudomonas aeruginosa* and other bacterial species. *Molecular bioSystems* 4(9):882-888.
30. Schuster M & Greenberg E P (2006) A network of networks: quorum-sensing gene regulation in *Pseudomonas aeruginosa. International journal of medical microbiology: IJMM* 296(2-3):73-81.
31. Schuster M, Hawkins A C, Harwood C S, & Greenberg E P (2004) The *Pseudomonas aeruginosa* RpoS regulon and its relationship to quorum sensing. *Molecular microbiology* 51(4):973-985.
32. Heurlier K, Dénervaud V, Pessi G, Reimmann C, & Haas D (2003) Negative control of quorum sensing by RpoN (sigma54) in *Pseudomonas aeruginosa* PAO1. *Journal of bacteriology* 185(7):2227-2235.
33. Fiske M J, Whitaker R J, & Jensen R A (1983) Hidden overflow pathway to L-phenylalanine in *Pseudomonas aeruginosa. Journal of bacteriology* 154(2):623-631.
34. Lindsey T L, Hagins J M, Sokol P A, & Siloh-Suh L A (2008) Virulence determinants from a cystic fibrosis isolate of *Pseudomonas aeruginosa* include isocitrate lyase. *Microbiology* 154:1616-1627.
35. Trunk K, et al. (2010) Anaerobic adaptation in *Pseudomonas aeruginosa*: definition of the Anr and Dnr regulons. *Environmental microbiology* 12(6):1719-1733.
36. Palmer K, Aye L, & Whitely M (2007) Nutritional cues control *Pseudomonas aeruginosa* multicellular behavior in cystic fibrosis sputum. *Journal of bacteriology* 189(22): 8079-8087.

The present invention is not to be limited in scope by the specific embodiments described herein. Indeed, various modifications of the invention in addition to those described herein will become apparent to those skilled in the art from the foregoing description. Such modifications are intended to fall within the scope of the appended claims.

All references cited herein are incorporated herein by reference in their entirety and for all purposes to the same extent as if each individual publication, patent or patent application was specifically and individually indicated to be incorporated by reference in its entirety for all purposes.

The citation of any publication is for its disclosure prior to the filing date and should not be construed as an admission that the present invention is not entitled to antedate such publication by virtue of prior invention.

SEQUENCE LISTING (10123 sequences)

SEQ ID NO: 1 - DNA, 17 bp, Artificial sequence
  Synthesized sequence
ctggcacggaccttgct

SEQ ID NO: 2 - DNA, 17 bp, Artificial sequence
  Synthesized sequence
ctggcacggcgcttgct

SEQ ID NO: 3 - DNA, 17 bp, Artificial sequence
  Synthesized sequence
ttggcacgggccttgct

SEQ ID NO: 4 - DNA, 17 bp, Artificial sequence
  Synthesized sequence
ttggcacgggccttgct

SEQ ID NO: 5 - DNA, 17 bp, Artificial sequence
  Synthesized sequence
atggcacgccgcttgct

SEQ ID NO: 6 - DNA, 17 bp, Artificial sequence
  Synthesized sequence
ctggcacgcaacttgct

SEQ ID NO: 7 - DNA, 17 bp, Artificial sequence
  Synthesized sequence
ctggcacagccattgct

SEQ ID NO: 8 - DNA, 17 bp, Artificial sequence
  Synthesized sequence
atggcacaacccttgct

SEQ ID NO: 9 - DNA, 17 bp, Artificial sequence
  Synthesized sequence
ctggcacggcccttgcg

SEQ ID NO: 10 - DNA, 17 bp, Artificial sequence
  Synthesized sequence
ctggcacagggcttgct

SEQ ID NO: 11 - DNA, 17 bp, Artificial sequence
  Synthesized sequence
gtggcaaggcccttgct

SEQ ID NO: 12 - DNA, 17 bp, Artificial sequence
  Synthesized sequence
ctggcaaggcccttgct

SEQ ID NO: 13 - DNA, 17 bp, Artificial sequence
  Synthesized sequence
ctggcatgtcgcttgct

SEQ ID NO: 14 - DNA, 17 bp, Artificial sequence
  Synthesized sequence
ttggcacccttgttgct

SEQ ID NO: 15 - DNA, 17 bp, Artificial sequence
  Synthesized sequence
ttggcacccttgttgct

SEQ ID NO: 16 - DNA, 17 bp, Artificial sequence
  Synthesized sequence
ctggcacgggctttgcg

SEQ ID NO: 17 - DNA, 17 bp, Artificial sequence
  Synthesized sequence
ctggcatagcgcttgct

SEQ ID NO: 18 - DNA, 17 bp, Artificial sequence
  Synthesized sequence
ttggtacggcccttgct

SEQ ID NO: 19 - DNA, 17 bp, Artificial sequence
  Synthesized sequence
ttggcaccctgcttgct

SEQ ID NO: 20 - DNA, 17 bp, Artificial sequence
  Synthesized sequence
ttggcaccctgcttgct

SEQ ID NO: 21 - DNA, 17 bp, Artificial sequence
  Synthesized sequence
ctggcacagcgcttgcg

SEQ ID NO: 22 - DNA, 17 bp, Artificial sequence
  Synthesized sequence
ctggcacagcgcttgcg

SEQ ID NO: 23 - DNA, 17 bp, Artificial sequence
  Synthesized sequence
ctggcacaagtcttgcg

SEQ ID NO: 24 - DNA, 17 bp, Artificial sequence
  Synthesized sequence
ttggcacggcacctgct

SEQ ID NO: 25 - DNA, 17 bp, Artificial sequence
  Synthesized sequence
ttggcccggaccttgct

SEQ ID NO: 26 - DNA, 17 bp, Artificial sequence
  Synthesized sequence
ttggcacggcgcctgct

SEQ ID NO: 27 - DNA, 17 bp, Artificial sequence
  Synthesized sequence
ctggcccggcccttgct

SEQ ID NO: 28 - DNA, 17 bp, Artificial sequence
  Synthesized sequence
atggcgcgggttttgca

SEQ ID NO: 29 - DNA, 17 bp, Artificial sequence
  Synthesized sequence
taggcacgggtattgct

SEQ ID NO: 30 - DNA, 17 bp, Artificial sequence
  Synthesized sequence
ttggcaaagagcttgct

SEQ ID NO: 31 - DNA, 17 bp, Artificial sequence
  Synthesized sequence
ctggcccgggccttgct

SEQ ID NO: 32 - DNA, 17 bp, Artificial sequence
  Synthesized sequence
ctggcacggctgtttct

SEQ ID NO: 33 - DNA, 17 bp, Artificial sequence
  Synthesized sequence
ctggcacgctttctgct

SEQ ID NO: 34 - DNA, 17 bp, Artificial sequence
  Synthesized sequence
ttggcatggtgcttgcc

SEQ ID NO: 35 - DNA, 17 bp, Artificial sequence
  Synthesized sequence
ttggaacagattttgct

SEQ ID NO: 36 - DNA, 17 bp, Artificial sequence
  Synthesized sequence
ctggcacgcaagctgca

SEQ ID NO: 37 - DNA, 17 bp, Artificial sequence
  Synthesized sequence
ctggcacgccgactgca

SEQ ID NO: 38 - DNA, 17 bp, Artificial sequence
  Synthesized sequence
ctggcacggttatcgca

SEQ ID NO: 39 - DNA, 17 bp, Artificial sequence
  Synthesized sequence
ccggcacgaccattgct

SEQ ID NO: 40 - DNA, 17 bp, Artificial sequence
  Synthesized sequence
ttggcacagccgctgct

SEQ ID NO: 41 - DNA, 17 bp, Artificial sequence
  Synthesized sequence
ttggcacagccgctgct

SEQ ID NO: 42 - DNA, 17 bp, Artificial sequence
  Synthesized sequence
ctggcatcggccttgct

SEQ ID NO: 43 - DNA, 17 bp, Artificial sequence
  Synthesized sequence
ctggcacgccgctcgct

SEQ ID NO: 44 - DNA, 17 bp, Artificial sequence
  Synthesized sequence
gtggtacagcgcttgct

SEQ ID NO: 45 - DNA, 17 bp, Artificial sequence
  Synthesized sequence
gtggcacgcgcctcgct

SEQ ID NO: 46 - DNA, 17 bp, Artificial sequence
  Synthesized sequence
ctggcacagcctctgca

SEQ ID NO: 47 - DNA, 17 bp, Artificial sequence
  Synthesized sequence
ctggaacaacagttgct

SEQ ID NO: 48 - DNA, 17 bp, Artificial sequence
  Synthesized sequence
ctggcaggcctgttgcg

SEQ ID NO: 49 - DNA, 17 bp, Artificial sequence
  Synthesized sequence
ctggcagaggctttgct

SEQ ID NO: 50 - DNA, 17 bp, Artificial sequence
  Synthesized sequence
ctggcacggttcctgcg

SEQ ID NO: 51 - DNA, 17 bp, Artificial sequence
  Synthesized sequence
atggcacggcgctttca

SEQ ID NO: 52 - DNA, 17 bp, Artificial sequence
  Synthesized sequence
ctggccccgctgttgct

SEQ ID NO: 53 - DNA, 17 bp, Artificial sequence
  Synthesized sequence
ttggcctgggtcttgct

SEQ ID NO: 54 - DNA, 17 bp, Artificial sequence
  Synthesized sequence
ctggcatggcttctgca

SEQ ID NO: 55 - DNA, 17 bp, Artificial sequence
  Synthesized sequence
ctggcatagctattgcc

SEQ ID NO: 56 - DNA, 17 bp, Artificial sequence
  Synthesized sequence
ctggcgcgcggattgct

SEQ ID NO: 57 - DNA, 17 bp, Artificial sequence
  Synthesized sequence
gaggcacagcctttgct

SEQ ID NO: 58 - DNA, 17 bp, Artificial sequence
  Synthesized sequence
ttggcacgaagcttgtt

SEQ ID NO: 59 - DNA, 17 bp, Artificial sequence
  Synthesized sequence
ccggcaccgctattgct

SEQ ID NO: 60 - DNA, 17 bp, Artificial sequence
  Synthesized sequence
ctggcgcgtggcttgca

SEQ ID NO: 61 - DNA, 17 bp, Artificial sequence
  Synthesized sequence
ctggcatggaagctgct

SEQ ID NO: 62 - DNA, 17 bp, Artificial sequence
  Synthesized sequence
atggcgctgttgttgct

SEQ ID NO: 63 - DNA, 17 bp, Artificial sequence
  Synthesized sequence
ctggtatggcgcttgca

SEQ ID NO: 64 - DNA, 17 bp, Artificial sequence
  Synthesized sequence
ttggcatcccggttgca

SEQ ID NO: 65 - DNA, 17 bp, Artificial sequence
  Synthesized sequence
ctggcatggttaatgct

SEQ ID NO: 66 - DNA, 17 bp, Artificial sequence
  Synthesized sequence
ctggaacgtgaattgct

SEQ ID NO: 67 - DNA, 17 bp, Artificial sequence
  Synthesized sequence
ctggcgcagcggttgca

SEQ ID NO: 68 - DNA, 17 bp, Artificial sequence
  Synthesized sequence
agggcacgtcatttgca

SEQ ID NO: 69 - DNA, 17 bp, Artificial sequence
  Synthesized sequence
ctggcgctgatgttgct

SEQ ID NO: 70 - DNA, 17 bp, Artificial sequence
  Synthesized sequence
atggcccacgagttgct

SEQ ID NO: 71 - DNA, 17 bp, Artificial sequence
  Synthesized sequence
gtggcgcgggacttgcc

SEQ ID NO: 72 - DNA, 17 bp, Artificial sequence
  Synthesized sequence
atggcccgccagttgcc

SEQ ID NO: 73 - DNA, 17 bp, Artificial sequence
  Synthesized sequence
gtggcacggttcttgtc

SEQ ID NO: 74 - DNA, 17 bp, Artificial sequence
  Synthesized sequence
ctggcacgcaagctgcg

SEQ ID NO: 75 - DNA, 17 bp, Artificial sequence
  Synthesized sequence
ctgggacggaccttgcc

SEQ ID NO: 76 - DNA, 17 bp, Artificial sequence
  Synthesized sequence
gtggcgctgcaattgct

SEQ ID NO: 77 - DNA, 17 bp, Artificial sequence
  Synthesized sequence
gtggcaaggggattgcg

SEQ ID NO: 78 - DNA, 17 bp, Artificial sequence
  Synthesized sequence
ctggcgcggcagttgcc

SEQ ID NO: 79 - DNA, 17 bp, Artificial sequence
  Synthesized sequence
gtggcccgccagttgcc

SEQ ID NO: 80 - DNA, 17 bp, Artificial sequence
  Synthesized sequence
ttggcctgggccttgca

SEQ ID NO: 81 - DNA, 17 bp, Artificial sequence
  Synthesized sequence
atggcgcggctcctgct

SEQ ID NO: 82 - DNA, 17 bp, Artificial sequence
  Synthesized sequence
ttggcatggtaagtgct

SEQ ID NO: 83 - DNA, 17 bp, Artificial sequence
  Synthesized sequence
ttggcccgggccttgcg

SEQ ID NO: 84 - DNA, 17 bp, Artificial sequence
  Synthesized sequence
ttggcaaggcacgtgct

SEQ ID NO: 85 - DNA, 17 bp, Artificial sequence
  Synthesized sequence
atggcatttgccttgct

SEQ ID NO: 86 - DNA, 17 bp, Artificial sequence
  Synthesized sequence
gtggccctggcgttgct

SEQ ID NO: 87 - DNA, 17 bp, Artificial sequence
  Synthesized sequence
ttggcacataactggct

SEQ ID NO: 88 - DNA, 17 bp, Artificial sequence
  Synthesized sequence
gtggtacggctaatgca

SEQ ID NO: 89 - DNA, 17 bp, Artificial sequence
  Synthesized sequence
atggcttgagatttgct

SEQ ID NO: 90 - DNA, 17 bp, Artificial sequence
  Synthesized sequence
ttggaacggttcctgca

SEQ ID NO: 91 - DNA, 17 bp, Artificial sequence
  Synthesized sequence
gtggcacgcgaaatgcg

SEQ ID NO: 92 - DNA, 17 bp, Artificial sequence
  Synthesized sequence
atggcgcggtgattgcc

SEQ ID NO: 93 - DNA, 17 bp, Artificial sequence
  Synthesized sequence
ttggcactgcgcttgat

SEQ ID NO: 94 - DNA, 17 bp, Artificial sequence
  Synthesized sequence
ctggcacgctggctgcg

SEQ ID NO: 95 - DNA, 17 bp, Artificial sequence
  Synthesized sequence
atggcaccatccatgca

SEQ ID NO: 96 - DNA, 17 bp, Artificial sequence
  Synthesized sequence
ttggtacgccttctgct

SEQ ID NO: 97 - DNA, 17 bp, Artificial sequence
  Synthesized sequence
ctggccagcctgttgca

SEQ ID NO: 98 - DNA, 17 bp, Artificial sequence
  Synthesized sequence
gcggcacgcaacttgcc

SEQ ID NO: 99 - DNA, 17 bp, Artificial sequence
  Synthesized sequence
ctggcacgaaactcgcc

SEQ ID NO: 100 - DNA, 17 bp, Artificial sequence
  Synthesized sequence
gtggcgggggtattgct

SEQ ID NO: 101 - DNA, 17 bp, Artificial sequence
  Synthesized sequence
ctggaacgcgaattgcg

SEQ ID NO: 102 - DNA, 17 bp, Artificial sequence
  Synthesized sequence
ccggcccggcttttgct

SEQ ID NO: 103 - DNA, 17 bp, Artificial sequence
  Synthesized sequence
ctggcatgcagcctgca

SEQ ID NO: 104 - DNA, 17 bp, Artificial sequence
  Synthesized sequence
gtggctcggtaattgcc

SEQ ID NO: 105 - DNA, 17 bp, Artificial sequence
  Synthesized sequence
gtggcgcggctgatgct

SEQ ID NO: 106 - DNA, 17 bp, Artificial sequence
  Synthesized sequence
ctggcccggcgcctgct

SEQ ID NO: 107 - DNA, 17 bp, Artificial sequence
  Synthesized sequence
ctggccggccacttgca

SEQ ID NO: 108 - DNA, 17 bp, Artificial sequence
  Synthesized sequence
ctggcacgcctgttggc

SEQ ID NO: 109 - DNA, 17 bp, Artificial sequence
  Synthesized sequence
atggcagaggctttgcg

SEQ ID NO: 110 - DNA, 17 bp, Artificial sequence
  Synthesized sequence
tcggcacggcgtttgcc

SEQ ID NO: 111 - DNA, 17 bp, Artificial sequence
  Synthesized sequence
gtggctcgcccattgcc

SEQ ID NO: 112 - DNA, 17 bp, Artificial sequence
  Synthesized sequence
ctggcaagctttctgct

SEQ ID NO: 113 - DNA, 17 bp, Artificial sequence
  Synthesized sequence
ctggccaggtatttgca

SEQ ID NO: 114 - DNA, 17 bp, Artificial sequence
  Synthesized sequence
gtggcacagttcttgtc

SEQ ID NO: 115 - DNA, 17 bp, Artificial sequence
  Synthesized sequence
ctggcgcggcgcctgct

SEQ ID NO: 116 - DNA, 17 bp, Artificial sequence
  Synthesized sequence
acggcaccgtatttgca

SEQ ID NO: 117 - DNA, 17 bp, Artificial sequence
  Synthesized sequence
ctggcgccgctattgcg

SEQ ID NO: 118 - DNA, 17 bp, Artificial sequence
  Synthesized sequence
ctggccggcgccttgct

SEQ ID NO: 119 - DNA, 17 bp, Artificial sequence
  Synthesized sequence
gtggcggagctgttgca

SEQ ID NO: 120 - DNA, 17 bp, Artificial sequence
  Synthesized sequence
ctggcactacagtggca

SEQ ID NO: 121 - DNA, 17 bp, Artificial sequence
  Synthesized sequence
gtggcacgataatggcc

SEQ ID NO: 122 - DNA, 17 bp, Artificial sequence
  Synthesized sequence
gtggcctgtccgttgca

SEQ ID NO: 123 - DNA, 17 bp, Artificial sequence
  Synthesized sequence
ctggaccggaccttgct

SEQ ID NO: 124 - DNA, 17 bp, Artificial sequence
  Synthesized sequence
ctggcccgggtgctgct

SEQ ID NO: 125 - DNA, 17 bp, Artificial sequence
  Synthesized sequence
gtggcctaccacttgca

SEQ ID NO: 126 - DNA, 17 bp, Artificial sequence
  Synthesized sequence
gtggtgcgcctgttgca

SEQ ID NO: 127 - DNA, 17 bp, Artificial sequence
  Synthesized sequence
ctggaacgcctgatgct

SEQ ID NO: 128 - DNA, 17 bp, Artificial sequence
  Synthesized sequence
ctggcaggactatttct

SEQ ID NO: 129 - DNA, 17 bp, Artificial sequence
  Synthesized sequence
acggcacggcttgtgca

SEQ ID NO: 130 - DNA, 17 bp, Artificial sequence
  Synthesized sequence
cttgcatggcgattgct

SEQ ID NO: 131 - DNA, 17 bp, Artificial sequence
  Synthesized sequence
ctggcaggggcactgct

SEQ ID NO: 132 - DNA, 17 bp, Artificial sequence
  Synthesized sequence
atgggacggttgatgct

SEQ ID NO: 133 - DNA, 17 bp, Artificial sequence
  Synthesized sequence
ttggccagtgtcttgct

SEQ ID NO: 134 - DNA, 17 bp, Artificial sequence
  Synthesized sequence
ctggcactggcgatgca

SEQ ID NO: 135 - DNA, 17 bp, Artificial sequence
  Synthesized sequence
ctggcggagatgttgct

SEQ ID NO: 136 - DNA, 17 bp, Artificial sequence
  Synthesized sequence
gtggaacgcctggtgct

SEQ ID NO: 137 - DNA, 17 bp, Artificial sequence
  Synthesized sequence
ttggcacgctcctcgcc

SEQ ID NO: 138 - DNA, 17 bp, Artificial sequence
  Synthesized sequence
ctggcccggccgctgct

SEQ ID NO: 139 - DNA, 17 bp, Artificial sequence
  Synthesized sequence
ctggaccgcctgttgca

SEQ ID NO: 140 - DNA, 17 bp, Artificial sequence
  Synthesized sequence
ttggcccaggccttgcc

SEQ ID NO: 141 - DNA, 17 bp, Artificial sequence
  Synthesized sequence
ctggctggcctgttgca

SEQ ID NO: 142 - DNA, 17 bp, Artificial sequence
  Synthesized sequence
gtcgcagggcttttgct

SEQ ID NO: 143 - DNA, 17 bp, Artificial sequence
  Synthesized sequence
atggcacgtttcttccg

SEQ ID NO: 144 - DNA, 17 bp, Artificial sequence
  Synthesized sequence
atggcgccgatcttgcc

SEQ ID NO: 145 - DNA, 17 bp, Artificial sequence
  Synthesized sequence
ttggcatgcggcctgca

SEQ ID NO: 146 - DNA, 17 bp, Artificial sequence
  Synthesized sequence
ttggcccttcctttgct

SEQ ID NO: 147 - DNA, 17 bp, Artificial sequence
  Synthesized sequence
ctggcatgcggcgtgca

SEQ ID NO: 148 - DNA, 17 bp, Artificial sequence
  Synthesized sequence
ctggcatgcggcgtgca

SEQ ID NO: 149 - DNA, 17 bp, Artificial sequence
  Synthesized sequence
caggcacggccactgct

SEQ ID NO: 150 - DNA, 17 bp, Artificial sequence
  Synthesized sequence
ttggcttcgttcttgct

SEQ ID NO: 151 - DNA, 17 bp, Artificial sequence
  Synthesized sequence
caggcaggccagttgca

SEQ ID NO: 152 - DNA, 17 bp, Artificial sequence
  Synthesized sequence
atggcgcgcaccgtgct

SEQ ID NO: 153 - DNA, 17 bp, Artificial sequence
  Synthesized sequence
ctggcccgcctctggca

SEQ ID NO: 154 - DNA, 17 bp, Artificial sequence
  Synthesized sequence
ctggcccgcctctggca

SEQ ID NO: 155 - DNA, 17 bp, Artificial sequence
  Synthesized sequence
ctggcccgcgacatgct

SEQ ID NO: 156 - DNA, 17 bp, Artificial sequence
  Synthesized sequence
gtggaagggatcttgcg

SEQ ID NO: 157 - DNA, 17 bp, Artificial sequence
  Synthesized sequence
ctggcgcggcaactgca

SEQ ID NO: 158 - DNA, 17 bp, Artificial sequence
  Synthesized sequence
ttggcccgaacaatgct

SEQ ID NO: 159 - DNA, 17 bp, Artificial sequence
  Synthesized sequence
gtggcgcggcgactgct

SEQ ID NO: 160 - DNA, 17 bp, Artificial sequence
  Synthesized sequence
ctggcgcggccctcgct

SEQ ID NO: 161 - DNA, 17 bp, Artificial sequence
  Synthesized sequence
ttggcatagagggtgct

SEQ ID NO: 162 - DNA, 17 bp, Artificial sequence
  Synthesized sequence
atggcgcggcgcgtgca

SEQ ID NO: 163 - DNA, 17 bp, Artificial sequence
  Synthesized sequence
gcggtacgggtgttgca

SEQ ID NO: 164 - DNA, 17 bp, Artificial sequence
  Synthesized sequence
ctggcatgcatcctgcc

SEQ ID NO: 165 - DNA, 17 bp, Artificial sequence
  Synthesized sequence
ctggcaaacggattgcg

SEQ ID NO: 166 - DNA, 17 bp, Artificial sequence
  Synthesized sequence
ctggctctgctgttgcg

SEQ ID NO: 167 - DNA, 17 bp, Artificial sequence
  Synthesized sequence
ccggcacgccccatgct

SEQ ID NO: 168 - DNA, 17 bp, Artificial sequence
  Synthesized sequence
atggcacggtcattggc

SEQ ID NO: 169 - DNA, 17 bp, Artificial sequence
  Synthesized sequence
atggaacgaatgtcgct

SEQ ID NO: 170 - DNA, 17 bp, Artificial sequence
  Synthesized sequence
gtggcgcaggcgttgcc

SEQ ID NO: 171 - DNA, 17 bp, Artificial sequence
  Synthesized sequence
gaggcacggcccgtgca

SEQ ID NO: 172 - DNA, 17 bp, Artificial sequence
  Synthesized sequence
ctggcgcgccgcctgca

SEQ ID NO: 173 - DNA, 17 bp, Artificial sequence
  Synthesized sequence
atggcgcggaagctgca

SEQ ID NO: 174 - DNA, 17 bp, Artificial sequence
  Synthesized sequence
ctgggagagcgcttgca

SEQ ID NO: 175 - DNA, 17 bp, Artificial sequence
  Synthesized sequence
ctggcgcgcagcgtgct

SEQ ID NO: 176 - DNA, 17 bp, Artificial sequence
  Synthesized sequence
ctggctcgccacctgca

SEQ ID NO: 177 - DNA, 17 bp, Artificial sequence
  Synthesized sequence
gtgttacggcacttgct

SEQ ID NO: 178 - DNA, 17 bp, Artificial sequence
  Synthesized sequence
atggtccgccagttgca

SEQ ID NO: 179 - DNA, 17 bp, Artificial sequence
  Synthesized sequence
ctggcccacatcctgct

SEQ ID NO: 180 - DNA, 17 bp, Artificial sequence
  Synthesized sequence
gtggccgggctgttgcg

SEQ ID NO: 181 - DNA, 17 bp, Artificial sequence
  Synthesized sequence
ctggcgggcgccttgca

SEQ ID NO: 182 - DNA, 17 bp, Artificial sequence
  Synthesized sequence
ctggcgctgctgttgcc

SEQ ID NO: 183 - DNA, 17 bp, Artificial sequence
  Synthesized sequence
gtggcgtagggattgct

SEQ ID NO: 184 - DNA, 17 bp, Artificial sequence
  Synthesized sequence
cgggtacggcccttgca

SEQ ID NO: 185 - DNA, 17 bp, Artificial sequence
  Synthesized sequence
ctggcacggctgatcct

SEQ ID NO: 186 - DNA, 17 bp, Artificial sequence
  Synthesized sequence
ttggcccggggtctgct

SEQ ID NO: 187 - DNA, 17 bp, Artificial sequence
  Synthesized sequence
ctggaacggcacttcct

SEQ ID NO: 188 - DNA, 17 bp, Artificial sequence
  Synthesized sequence
gtggcccgctacctgca

SEQ ID NO: 189 - DNA, 17 bp, Artificial sequence
  Synthesized sequence
gtggaacgggtcttgat

SEQ ID NO: 190 - DNA, 17 bp, Artificial sequence
  Synthesized sequence
gaggcacgccgcctgct

SEQ ID NO: 191 - DNA, 17 bp, Artificial sequence
  Synthesized sequence
ggggcacggcgcgtgct

SEQ ID NO: 192 - DNA, 17 bp, Artificial sequence
  Synthesized sequence
ctggcccgcgccctgct

SEQ ID NO: 193 - DNA, 17 bp, Artificial sequence
  Synthesized sequence
ctggcccggcaattgat

SEQ ID NO: 194 - DNA, 17 bp, Artificial sequence
  Synthesized sequence
ctggcgcaatggttgcg

SEQ ID NO: 195 - DNA, 17 bp, Artificial sequence
  Synthesized sequence
ctggcgcgccaggtgca

SEQ ID NO: 196 - DNA, 17 bp, Artificial sequence
  Synthesized sequence
gtggcccgcaactggct

SEQ ID NO: 197 - DNA, 17 bp, Artificial sequence
  Synthesized sequence
gtggcgcggcgcttgaa

SEQ ID NO: 198 - DNA, 17 bp, Artificial sequence
  Synthesized sequence
ctggcgggcgggttgca

SEQ ID NO: 199 - DNA, 17 bp, Artificial sequence
  Synthesized sequence
gtggcctggatcctgct

SEQ ID NO: 200 - DNA, 17 bp, Artificial sequence
  Synthesized sequence
ctggccgcgcacttgct

SEQ ID NO: 201 - DNA, 17 bp, Artificial sequence
  Synthesized sequence
caggcacgaagcctgca

SEQ ID NO: 202 - DNA, 17 bp, Artificial sequence
  Synthesized sequence
ctgacactgtgtttgca

SEQ ID NO: 203 - DNA, 17 bp, Artificial sequence
  Synthesized sequence
aaggcacgcctgatgca

SEQ ID NO: 204 - DNA, 17 bp, Artificial sequence
  Synthesized sequence
ctggtacgtcaggtgca

SEQ ID NO: 205 - DNA, 17 bp, Artificial sequence
  Synthesized sequence
ccggcacgccggctgct

SEQ ID NO: 206 - DNA, 17 bp, Artificial sequence
  Synthesized sequence
ctggcacgattctcggt

SEQ ID NO: 207 - DNA, 17 bp, Artificial sequence
  Synthesized sequence
ttggcccaggtagtgct

SEQ ID NO: 208 - DNA, 17 bp, Artificial sequence
  Synthesized sequence
ctggcgcgcgtctcgca

SEQ ID NO: 209 - DNA, 17 bp, Artificial sequence
  Synthesized sequence
gtggcgcgccaactgca

SEQ ID NO: 210 - DNA, 17 bp, Artificial sequence
  Synthesized sequence
ctggcaagccgcttcca

SEQ ID NO: 211 - DNA, 17 bp, Artificial sequence
  Synthesized sequence
tcggcaccgcgcttgcc

SEQ ID NO: 212 - DNA, 17 bp, Artificial sequence
  Synthesized sequence
ctggcccaactggtgct

SEQ ID NO: 213 - DNA, 17 bp, Artificial sequence
  Synthesized sequence
ctggccctggccttgcg

SEQ ID NO: 214 - DNA, 17 bp, Artificial sequence
  Synthesized sequence
cgggcaggttttttgct

SEQ ID NO: 215 - DNA, 17 bp, Artificial sequence
  Synthesized sequence
ttagcacgcagtttgcc

SEQ ID NO: 216 - DNA, 17 bp, Artificial sequence
  Synthesized sequence
ctggcacggcctgttct

SEQ ID NO: 217 - DNA, 17 bp, Artificial sequence
  Synthesized sequence
gtggccgaccgtttgct

SEQ ID NO: 218 - DNA, 17 bp, Artificial sequence
  Synthesized sequence
ctggcgcgcgtggtgca

SEQ ID NO: 219 - DNA, 17 bp, Artificial sequence
  Synthesized sequence
atggcatgcaccgtgcc

SEQ ID NO: 220 - DNA, 17 bp, Artificial sequence
  Synthesized sequence
gtggctcgagcgctgct

SEQ ID NO: 221 - DNA, 17 bp, Artificial sequence
  Synthesized sequence
ctggcgcggtgctggct

SEQ ID NO: 222 - DNA, 17 bp, Artificial sequence
  Synthesized sequence
gtggccggctggttgca

SEQ ID NO: 223 - DNA, 17 bp, Artificial sequence
  Synthesized sequence
acggcgcgaaccttgca

SEQ ID NO: 224 - DNA, 17 bp, Artificial sequence
  Synthesized sequence
gtggtagcgctgttgca

SEQ ID NO: 225 - DNA, 17 bp, Artificial sequence
  Synthesized sequence
atggcacattcattcca

SEQ ID NO: 226 - DNA, 17 bp, Artificial sequence
  Synthesized sequence
ctggcacgcaccgcgct

SEQ ID NO: 227 - DNA, 17 bp, Artificial sequence
  Synthesized sequence
ctgccatgccggttgca

SEQ ID NO: 228 - DNA, 17 bp, Artificial sequence
  Synthesized sequence
ttggcacgcttcctgaa

SEQ ID NO: 229 - DNA, 17 bp, Artificial sequence
  Synthesized sequence
ttggaacgcatcttcct

SEQ ID NO: 230 - DNA, 17 bp, Artificial sequence
  Synthesized sequence
ctggtagcgcacttgca

SEQ ID NO: 231 - DNA, 17 bp, Artificial sequence
  Synthesized sequence
ctggcatgaaagctgcc

SEQ ID NO: 232 - DNA, 17 bp, Artificial sequence
  Synthesized sequence
ctggcacgcatcgagca

SEQ ID NO: 233 - DNA, 17 bp, Artificial sequence
  Synthesized sequence
atggcaagcatcgtgcg

SEQ ID NO: 234 - DNA, 17 bp, Artificial sequence
  Synthesized sequence
ctggcaagcaagtcgca

SEQ ID NO: 235 - DNA, 17 bp, Artificial sequence
  Synthesized sequence
atggcatacctcctgcg

SEQ ID NO: 236 - DNA, 17 bp, Artificial sequence
  Synthesized sequence
ctggcgcaacgcctgct

SEQ ID NO: 237 - DNA, 17 bp, Artificial sequence
  Synthesized sequence
ctggcggcactgttgct

SEQ ID NO: 238 - DNA, 17 bp, Artificial sequence
  Synthesized sequence
ctggaacgcgtctggct

SEQ ID NO: 239 - DNA, 17 bp, Artificial sequence
  Synthesized sequence
ctggcgctgctcctgct

SEQ ID NO: 240 - DNA, 17 bp, Artificial sequence
  Synthesized sequence
ctggcgccgagcttgcg

SEQ ID NO: 241 - DNA, 17 bp, Artificial sequence
  Synthesized sequence
atggcacggttccttca

SEQ ID NO: 242 - DNA, 17 bp, Artificial sequence
  Synthesized sequence
ctggcccggtgaatgct

SEQ ID NO: 243 - DNA, 17 bp, Artificial sequence
  Synthesized sequence
cgggcccgccagttgct

SEQ ID NO: 244 - DNA, 17 bp, Artificial sequence
  Synthesized sequence
gtggctcgagcgctgct

SEQ ID NO: 245 - DNA, 17 bp, Artificial sequence
  Synthesized sequence
ctggcccaggtgctgct

SEQ ID NO: 246 - DNA, 17 bp, Artificial sequence
  Synthesized sequence
ctggcccaggacgtgct

SEQ ID NO: 247 - DNA, 17 bp, Artificial sequence
  Synthesized sequence
ctgggacggcaattcct

SEQ ID NO: 248 - DNA, 17 bp, Artificial sequence
  Synthesized sequence
ctggcatggacctggcg

SEQ ID NO: 249 - DNA, 17 bp, Artificial sequence
  Synthesized sequence
ctggcgcgccagctgca

SEQ ID NO: 250 - DNA, 17 bp, Artificial sequence
  Synthesized sequence
ctggcgcgcggcgtgct

SEQ ID NO: 251 - DNA, 17 bp, Artificial sequence
  Synthesized sequence
attgcacactttttgcg

SEQ ID NO: 252 - DNA, 17 bp, Artificial sequence
  Synthesized sequence
ctggcgcagttgctgca

SEQ ID NO: 253 - DNA, 17 bp, Artificial sequence
  Synthesized sequence
taggcatggcatttgcc

SEQ ID NO: 254 - DNA, 17 bp, Artificial sequence
  Synthesized sequence
ttgccatgttagttgct

SEQ ID NO: 255 - DNA, 17 bp, Artificial sequence
  Synthesized sequence
ctggcaccggcctcgcc

SEQ ID NO: 256 - DNA, 17 bp, Artificial sequence
  Synthesized sequence
ctcgcacgggtgctgca

SEQ ID NO: 257 - DNA, 17 bp, Artificial sequence
  Synthesized sequence
ctggcacagcgatttcc

SEQ ID NO: 258 - DNA, 17 bp, Artificial sequence
  Synthesized sequence
ttggcgccccgtttgcg

SEQ ID NO: 259 - DNA, 17 bp, Artificial sequence
  Synthesized sequence
gtcgcccgcctgttgca

SEQ ID NO: 260 - DNA, 17 bp, Artificial sequence
  Synthesized sequence
ctggcgcatctggtgct

SEQ ID NO: 261 - DNA, 17 bp, Artificial sequence
  Synthesized sequence
ctggccgacgagttgct

SEQ ID NO: 262 - DNA, 17 bp, Artificial sequence
  Synthesized sequence
ctggcacacttcctgat

SEQ ID NO: 263 - DNA, 17 bp, Artificial sequence
  Synthesized sequence
ctggcgctggtcctgct

SEQ ID NO: 264 - DNA, 17 bp, Artificial sequence
  Synthesized sequence
ctggtcctgctgttgca

SEQ ID NO: 265 - DNA, 17 bp, Artificial sequence
  Synthesized sequence
ctggcgcgggtcctgcg

SEQ ID NO: 266 - DNA, 17 bp, Artificial sequence
  Synthesized sequence
ccggcaaggcccttgcc

SEQ ID NO: 267 - DNA, 17 bp, Artificial sequence
  Synthesized sequence
atggcatgcacctggcg

SEQ ID NO: 268 - DNA, 17 bp, Artificial sequence
  Synthesized sequence
ctggtgccgctgttgct

SEQ ID NO: 269 - DNA, 17 bp, Artificial sequence
  Synthesized sequence
ctggcgcggatggtgcg

SEQ ID NO: 270 - DNA, 17 bp, Artificial sequence
  Synthesized sequence
ctggaacggagatggca

SEQ ID NO: 271 - DNA, 17 bp, Artificial sequence
  Synthesized sequence
ctggcgcggggctggca

SEQ ID NO: 272 - DNA, 17 bp, Artificial sequence
  Synthesized sequence
atggcacccaactggcg

SEQ ID NO: 273 - DNA, 17 bp, Artificial sequence
  Synthesized sequence
ttggtccggcagttgcg

SEQ ID NO: 274 - DNA, 17 bp, Artificial sequence
  Synthesized sequence
ctgccacgggccctgct

SEQ ID NO: 275 - DNA, 17 bp, Artificial sequence
  Synthesized sequence
ctggcaggtgcgctgca

SEQ ID NO: 276 - DNA, 17 bp, Artificial sequence
  Synthesized sequence
ctggcgccattcctgct

SEQ ID NO: 277 - DNA, 17 bp, Artificial sequence
  Synthesized sequence
ctggcagcgcaactgca

SEQ ID NO: 278 - DNA, 17 bp, Artificial sequence
  Synthesized sequence
atggctcgcggcgtgct

SEQ ID NO: 279 - DNA, 17 bp, Artificial sequence
  Synthesized sequence
gtggcgcacggtttgcc

SEQ ID NO: 280 - DNA, 17 bp, Artificial sequence
  Synthesized sequence
gtggcgcacggtttgcc

SEQ ID NO: 281 - DNA, 17 bp, Artificial sequence
  Synthesized sequence
atgccacgcctgctgca

SEQ ID NO: 282 - DNA, 17 bp, Artificial sequence
  Synthesized sequence
ctggcccaggccctgct

SEQ ID NO: 283 - DNA, 17 bp, Artificial sequence
  Synthesized sequence
atggcaggccctttcca

SEQ ID NO: 284 - DNA, 17 bp, Artificial sequence
  Synthesized sequence
gtggcacgcaagctggt

SEQ ID NO: 285 - DNA, 17 bp, Artificial sequence
  Synthesized sequence
ctggtactgttcatgca

SEQ ID NO: 286 - DNA, 17 bp, Artificial sequence
  Synthesized sequence
gtggcatggccatggcc

SEQ ID NO: 287 - DNA, 17 bp, Artificial sequence
  Synthesized sequence
ctggccctggtcctgct

SEQ ID NO: 288 - DNA, 17 bp, Artificial sequence
  Synthesized sequence
ctggcgcgacggtcgca

SEQ ID NO: 289 - DNA, 17 bp, Artificial sequence
  Synthesized sequence
ccggcacgggctgtgca

SEQ ID NO: 290 - DNA, 17 bp, Artificial sequence
  Synthesized sequence
ctggcgcgcgcctggct

SEQ ID NO: 291 - DNA, 17 bp, Artificial sequence
  Synthesized sequence
ctggccgccctgttgct

SEQ ID NO: 292 - DNA, 17 bp, Artificial sequence
  Synthesized sequence
ctggcacgggtggtcca

SEQ ID NO: 293 - DNA, 17 bp, Artificial sequence
  Synthesized sequence
atggctccgctcctgca

SEQ ID NO: 294 - DNA, 17 bp, Artificial sequence
  Synthesized sequence
gtggcgcgccagttgat

SEQ ID NO: 295 - DNA, 17 bp, Artificial sequence
  Synthesized sequence
ctggcccggcccctgcg

SEQ ID NO: 296 - DNA, 17 bp, Artificial sequence
  Synthesized sequence
ctggccctggtcctgct

SEQ ID NO: 297 - DNA, 17 bp, Artificial sequence
  Synthesized sequence
ctggggcgcgctttgca

SEQ ID NO: 298 - DNA, 17 bp, Artificial sequence
  Synthesized sequence
ctggaacgcctgctgcg

SEQ ID NO: 299 - DNA, 17 bp, Artificial sequence
  Synthesized sequence
tcggcatcggccttgct

SEQ ID NO: 300 - DNA, 17 bp, Artificial sequence
  Synthesized sequence
gtggcccgcgactggct

SEQ ID NO: 301 - DNA, 17 bp, Artificial sequence
  Synthesized sequence
gtcgaacgcctgttgca

SEQ ID NO: 302 - DNA, 17 bp, Artificial sequence
  Synthesized sequence
gtggcgcagaaggtgct

SEQ ID NO: 303 - DNA, 17 bp, Artificial sequence
  Synthesized sequence
ctggcgcgcgagctgca

SEQ ID NO: 304 - DNA, 17 bp, Artificial sequence
  Synthesized sequence
cttgcgcggcagttgca

SEQ ID NO: 305 - DNA, 17 bp, Artificial sequence
  Synthesized sequence
atggcccccgccttgcg

SEQ ID NO: 306 - DNA, 17 bp, Artificial sequence
  Synthesized sequence
ctggaccgtcagttgca

SEQ ID NO: 307 - DNA, 17 bp, Artificial sequence
  Synthesized sequence
ttggaacgctggctgca

SEQ ID NO: 308 - DNA, 17 bp, Artificial sequence
  Synthesized sequence
ttggcgcagcgtctgca

SEQ ID NO: 309 - DNA, 17 bp, Artificial sequence
  Synthesized sequence
ctggcgcggctgctgcc

SEQ ID NO: 310 - DNA, 17 bp, Artificial sequence
  Synthesized sequence
ctggcccaggaactgct

SEQ ID NO: 311 - DNA, 17 bp, Artificial sequence
  Synthesized sequence
ctggaactgggcttgcc

SEQ ID NO: 312 - DNA, 17 bp, Artificial sequence
  Synthesized sequence
atggtacagcggctgca

SEQ ID NO: 313 - DNA, 17 bp, Artificial sequence
  Synthesized sequence
ctggcccaggcgctgct

SEQ ID NO: 314 - DNA, 17 bp, Artificial sequence
  Synthesized sequence
ctggaacgggtcctgcg

SEQ ID NO: 315 - DNA, 17 bp, Artificial sequence
  Synthesized sequence
caggcgcagcaattgct

SEQ ID NO: 316 - DNA, 17 bp, Artificial sequence
  Synthesized sequence
gcggcacgggacttgat

SEQ ID NO: 317 - DNA, 17 bp, Artificial sequence
  Synthesized sequence
ctggcgccgggcttgcc

SEQ ID NO: 318 - DNA, 17 bp, Artificial sequence
  Synthesized sequence
ctggccgtgcgcttgct

SEQ ID NO: 319 - DNA, 17 bp, Artificial sequence
  Synthesized sequence
tgggcaaatatcttgca

SEQ ID NO: 320 - DNA, 17 bp, Artificial sequence
  Synthesized sequence
ctggccggcctattgcc

SEQ ID NO: 321 - DNA, 17 bp, Artificial sequence
  Synthesized sequence
ttcgcccgccagttgct

SEQ ID NO: 322 - DNA, 17 bp, Artificial sequence
  Synthesized sequence
atggcacaagcatggcc

SEQ ID NO: 323 - DNA, 17 bp, Artificial sequence
  Synthesized sequence
gtggcgtgtaccttgcg

SEQ ID NO: 324 - DNA, 17 bp, Artificial sequence
  Synthesized sequence
atggcacgcaggccgct

SEQ ID NO: 325 - DNA, 17 bp, Artificial sequence
  Synthesized sequence
ctggctcgcgggctgct

SEQ ID NO: 326 - DNA, 17 bp, Artificial sequence
  Synthesized sequence
cttgcccgccacttgca

SEQ ID NO: 327 - DNA, 17 bp, Artificial sequence
  Synthesized sequence
ctggcccggctgctgcc

SEQ ID NO: 328 - DNA, 17 bp, Artificial sequence
  Synthesized sequence
gtgccccggtccttgct

SEQ ID NO: 329 - DNA, 17 bp, Artificial sequence
  Synthesized sequence
caggcatataatttgct

SEQ ID NO: 330 - DNA, 17 bp, Artificial sequence
  Synthesized sequence
gcggcacagatgctgca

SEQ ID NO: 331 - DNA, 17 bp, Artificial sequence
  Synthesized sequence
atgggattctccttgct

SEQ ID NO: 332 - DNA, 17 bp, Artificial sequence
  Synthesized sequence
gtggcctcggcgttgca

SEQ ID NO: 333 - DNA, 17 bp, Artificial sequence
  Synthesized sequence
ctggcgcgactgctgcg

SEQ ID NO: 334 - DNA, 17 bp, Artificial sequence
  Synthesized sequence
ctggcacagcaccggca

SEQ ID NO: 335 - DNA, 17 bp, Artificial sequence
  Synthesized sequence
ggggcccgtcctttgct

SEQ ID NO: 336 - DNA, 17 bp, Artificial sequence
  Synthesized sequence
ctggcactggatgtgcg

SEQ ID NO: 337 - DNA, 17 bp, Artificial sequence
  Synthesized sequence
atggcaatgagcctgct

SEQ ID NO: 338 - DNA, 17 bp, Artificial sequence
  Synthesized sequence
ctggtcctgctgttgct

SEQ ID NO: 339 - DNA, 17 bp, Artificial sequence
  Synthesized sequence
ctggtgcagaagttgca

SEQ ID NO: 340 - DNA, 17 bp, Artificial sequence
  Synthesized sequence
atggtacaggaagtgct

SEQ ID NO: 341 - DNA, 17 bp, Artificial sequence
  Synthesized sequence
ctggcgccgctgctgct

SEQ ID NO: 342 - DNA, 17 bp, Artificial sequence
  Synthesized sequence
ctggcaccgtcgctgcc

SEQ ID NO: 343 - DNA, 17 bp, Artificial sequence
  Synthesized sequence
gtggcgccgctgatgct

SEQ ID NO: 344 - DNA, 17 bp, Artificial sequence
  Synthesized sequence
atggcgggaaacttgcc

SEQ ID NO: 345 - DNA, 17 bp, Artificial sequence
  Synthesized sequence
atggcgcgcagcttgaa

SEQ ID NO: 346 - DNA, 17 bp, Artificial sequence
  Synthesized sequence
ctggcgcgcttcgtgcc

SEQ ID NO: 347 - DNA, 17 bp, Artificial sequence
  Synthesized sequence
gtggcacgcacggtggt

SEQ ID NO: 348 - DNA, 17 bp, Artificial sequence
  Synthesized sequence
gaggcgccgctgttgct

SEQ ID NO: 349 - DNA, 17 bp, Artificial sequence
  Synthesized sequence
ctggcagatcgaatgct

SEQ ID NO: 350 - DNA, 17 bp, Artificial sequence
  Synthesized sequence
ttggcatggtgcttacg

SEQ ID NO: 351 - DNA, 17 bp, Artificial sequence
  Synthesized sequence
gtggcccgccacctgcg

SEQ ID NO: 352 - DNA, 17 bp, Artificial sequence
  Synthesized sequence
atggctcgtattttgat

SEQ ID NO: 353 - DNA, 17 bp, Artificial sequence
  Synthesized sequence
ccggcacgcttcctgcg

SEQ ID NO: 354 - DNA, 17 bp, Artificial sequence
  Synthesized sequence
gttgctcggcggttgca

SEQ ID NO: 355 - DNA, 17 bp, Artificial sequence
  Synthesized sequence
cggccacggcggttgct

SEQ ID NO: 356 - DNA, 17 bp, Artificial sequence
  Synthesized sequence
ctggcctggccgctgct

SEQ ID NO: 357 - DNA, 17 bp, Artificial sequence
  Synthesized sequence
gtggccgataccttgca

SEQ ID NO: 358 - DNA, 17 bp, Artificial sequence
  Synthesized sequence
ttcgcccaggttttgct

SEQ ID NO: 359 - DNA, 17 bp, Artificial sequence
  Synthesized sequence
tcggcacggactttcct

SEQ ID NO: 360 - DNA, 17 bp, Artificial sequence
  Synthesized sequence
cgggcacaaatgtcgct

SEQ ID NO: 361 - DNA, 17 bp, Artificial sequence
  Synthesized sequence
ctggctgatcagttgct

SEQ ID NO: 362 - DNA, 17 bp, Artificial sequence
  Synthesized sequence
caggcactgatcctgct

SEQ ID NO: 363 - DNA, 17 bp, Artificial sequence
  Synthesized sequence
ttggcaaaggccttact

SEQ ID NO: 364 - DNA, 17 bp, Artificial sequence
  Synthesized sequence
ttggcaaaggccttact

SEQ ID NO: 365 - DNA, 17 bp, Artificial sequence
  Synthesized sequence
atggcgcgggcattcct

SEQ ID NO: 366 - DNA, 17 bp, Artificial sequence
  Synthesized sequence
ctggcacggttgtagta

SEQ ID NO: 367 - DNA, 17 bp, Artificial sequence
  Synthesized sequence
gtggcctgcctggtgct

SEQ ID NO: 368 - DNA, 17 bp, Artificial sequence
  Synthesized sequence
ctggcgcgcctgctgcc

SEQ ID NO: 369 - DNA, 17 bp, Artificial sequence
  Synthesized sequence
gtggcaggatgcatgcc

SEQ ID NO: 370 - DNA, 17 bp, Artificial sequence
  Synthesized sequence
ctcgctcgcaccttgct

SEQ ID NO: 371 - DNA, 17 bp, Artificial sequence
  Synthesized sequence
ttggcccggaagctgcg

SEQ ID NO: 372 - DNA, 17 bp, Artificial sequence
  Synthesized sequence
gtggcgcggcactcgcc

SEQ ID NO: 373 - DNA, 17 bp, Artificial sequence
  Synthesized sequence
ctggaacagggcctgca

SEQ ID NO: 374 - DNA, 17 bp, Artificial sequence
  Synthesized sequence
ctggcgcgtgggctgct

SEQ ID NO: 375 - DNA, 17 bp, Artificial sequence
  Synthesized sequence
ctggtgccgatgttgca

SEQ ID NO: 376 - DNA, 17 bp, Artificial sequence
  Synthesized sequence
ccggcactgatcctgct

SEQ ID NO: 377 - DNA, 17 bp, Artificial sequence
  Synthesized sequence
acggcacgcccattgat

SEQ ID NO: 378 - DNA, 17 bp, Artificial sequence
  Synthesized sequence
ttggcgtagggcttgcg

SEQ ID NO: 379 - DNA, 17 bp, Artificial sequence
  Synthesized sequence
ttggcgcgcctgatgcc

SEQ ID NO: 380 - DNA, 17 bp, Artificial sequence
  Synthesized sequence
ctggcgctactggtgct

SEQ ID NO: 381 - DNA, 17 bp, Artificial sequence
  Synthesized sequence
ctggcgctactggtgct

SEQ ID NO: 382 - DNA, 17 bp, Artificial sequence
  Synthesized sequence
ctggaacgcatcctgcc

SEQ ID NO: 383 - DNA, 17 bp, Artificial sequence
  Synthesized sequence
ctggaacgccacctgcc

SEQ ID NO: 384 - DNA, 17 bp, Artificial sequence
  Synthesized sequence
ctggcgcgggtgctgcg

SEQ ID NO: 385 - DNA, 17 bp, Artificial sequence
  Synthesized sequence
ttggcaaagtcgttgga

SEQ ID NO: 386 - DNA, 17 bp, Artificial sequence
  Synthesized sequence
aaggctcgcgggttgct

SEQ ID NO: 387 - DNA, 17 bp, Artificial sequence
  Synthesized sequence
ctggcgccgagcctgct

SEQ ID NO: 388 - DNA, 17 bp, Artificial sequence
  Synthesized sequence
ctggcgcaggcgctgca

SEQ ID NO: 389 - DNA, 17 bp, Artificial sequence
  Synthesized sequence
ccggcatatgccttgca

SEQ ID NO: 390 - DNA, 17 bp, Artificial sequence
  Synthesized sequence
gcggccctgctgttgct

SEQ ID NO: 391 - DNA, 17 bp, Artificial sequence
  Synthesized sequence
atggcaagactttagcc

SEQ ID NO: 392 - DNA, 17 bp, Artificial sequence
  Synthesized sequence
ctggcggacgcattgca

SEQ ID NO: 393 - DNA, 17 bp, Artificial sequence
  Synthesized sequence
atggctcaggaggtgct

SEQ ID NO: 394 - DNA, 17 bp, Artificial sequence
  Synthesized sequence
ctggtacgggtgctgcc

SEQ ID NO: 395 - DNA, 17 bp, Artificial sequence
  Synthesized sequence
ctggccccgcgcatgca

SEQ ID NO: 396 - DNA, 17 bp, Artificial sequence
  Synthesized sequence
gtggccaggtggttgcg

SEQ ID NO: 397 - DNA, 17 bp, Artificial sequence
  Synthesized sequence
atggcgggcaagttgcg

SEQ ID NO: 398 - DNA, 17 bp, Artificial sequence
  Synthesized sequence
gtggcaaaccgcttgta

SEQ ID NO: 399 - DNA, 17 bp, Artificial sequence
  Synthesized sequence
ctggcaaggccgtggcg

SEQ ID NO: 400 - DNA, 17 bp, Artificial sequence
  Synthesized sequence
ttcgcccagcagttgct

SEQ ID NO: 401 - DNA, 17 bp, Artificial sequence
  Synthesized sequence
ctggcacgaacgctact

SEQ ID NO: 402 - DNA, 17 bp, Artificial sequence
  Synthesized sequence
atggcatgggagtcgcc

SEQ ID NO: 403 - DNA, 17 bp, Artificial sequence
  Synthesized sequence
gtggatcaggacttgca

SEQ ID NO: 404 - DNA, 17 bp, Artificial sequence
  Synthesized sequence
gtggaatttcagttgca

SEQ ID NO: 405 - DNA, 17 bp, Artificial sequence
  Synthesized sequence
ctggcgcaaccgctgca

SEQ ID NO: 406 - DNA, 17 bp, Artificial sequence
  Synthesized sequence
ctggcggcgcggttgct

SEQ ID NO: 407 - DNA, 17 bp, Artificial sequence
  Synthesized sequence
ctggcactgaccttccc

SEQ ID NO: 408 - DNA, 17 bp, Artificial sequence
  Synthesized sequence
ctggggcagcggttgca

SEQ ID NO: 409 - DNA, 17 bp, Artificial sequence
  Synthesized sequence
ctggggcagcggttgca

SEQ ID NO: 410 - DNA, 17 bp, Artificial sequence
  Synthesized sequence
ctggcacgcgacctgga

SEQ ID NO: 411 - DNA, 17 bp, Artificial sequence
  Synthesized sequence
ttggcgaacaggttgca

SEQ ID NO: 412 - DNA, 17 bp, Artificial sequence
  Synthesized sequence
gtggtacagccattggt

SEQ ID NO: 413 - DNA, 17 bp, Artificial sequence
  Synthesized sequence
ctgggaccgatctcgct

SEQ ID NO: 414 - DNA, 17 bp, Artificial sequence
  Synthesized sequence
ctggcgcggatactgcc

SEQ ID NO: 415 - DNA, 17 bp, Artificial sequence
  Synthesized sequence
ctggtacgctggttcct

SEQ ID NO: 416 - DNA, 17 bp, Artificial sequence
  Synthesized sequence
gtggcgtggcgtgtgct

SEQ ID NO: 417 - DNA, 17 bp, Artificial sequence
  Synthesized sequence
ctggcgcgcttcctgcc

SEQ ID NO: 418 - DNA, 17 bp, Artificial sequence
  Synthesized sequence
ttggcctggcgcctgca

SEQ ID NO: 419 - DNA, 17 bp, Artificial sequence
  Synthesized sequence
ttggcctggcgcctgca

SEQ ID NO: 420 - DNA, 17 bp, Artificial sequence
  Synthesized sequence
ctggcacgtgacgcgca

SEQ ID NO: 421 - DNA, 17 bp, Artificial sequence
  Synthesized sequence
atggcctgcctgatgct

SEQ ID NO: 422 - DNA, 17 bp, Artificial sequence
  Synthesized sequence
ctggccctgtacctgct

SEQ ID NO: 423 - DNA, 17 bp, Artificial sequence
  Synthesized sequence
ctggcacgggcggggca

SEQ ID NO: 424 - DNA, 17 bp, Artificial sequence
  Synthesized sequence
ctggcccgtgcgctgct

SEQ ID NO: 425 - DNA, 17 bp, Artificial sequence
  Synthesized sequence
ctggtaccacccgtgct

SEQ ID NO: 426 - DNA, 17 bp, Artificial sequence
  Synthesized sequence
ctggcgccgaccctgct

SEQ ID NO: 427 - DNA, 17 bp, Artificial sequence
  Synthesized sequence
ctggccggggtcctgct

SEQ ID NO: 428 - DNA, 17 bp, Artificial sequence
  Synthesized sequence
ttggcccaggcttcgct

SEQ ID NO: 429 - DNA, 17 bp, Artificial sequence
  Synthesized sequence
tgggcctgcatcttgct

SEQ ID NO: 430 - DNA, 17 bp, Artificial sequence
  Synthesized sequence
atggaacagcagttggt

SEQ ID NO: 431 - DNA, 17 bp, Artificial sequence
  Synthesized sequence
cgggcacgccgatggct

SEQ ID NO: 432 - DNA, 17 bp, Artificial sequence
  Synthesized sequence
atcgaacgccagttgca

SEQ ID NO: 433 - DNA, 17 bp, Artificial sequence
  Synthesized sequence
atcgaacgccagttgca

SEQ ID NO: 434 - DNA, 17 bp, Artificial sequence
  Synthesized sequence
ctggccctgttgctgct

SEQ ID NO: 435 - DNA, 17 bp, Artificial sequence
  Synthesized sequence
ctggcgcagaactggca

SEQ ID NO: 436 - DNA, 17 bp, Artificial sequence
  Synthesized sequence
gtggcacgcggcctggt

SEQ ID NO: 437 - DNA, 17 bp, Artificial sequence
  Synthesized sequence
gtggcatggcaattccc

SEQ ID NO: 438 - DNA, 17 bp, Artificial sequence
  Synthesized sequence
caggcacggtcattcct

SEQ ID NO: 439 - DNA, 17 bp, Artificial sequence
  Synthesized sequence
ctggcagcacggctgct

SEQ ID NO: 440 - DNA, 17 bp, Artificial sequence
  Synthesized sequence
ctggctcggcggttcca

SEQ ID NO: 441 - DNA, 17 bp, Artificial sequence
  Synthesized sequence
atggcgcgcaacttcca

SEQ ID NO: 442 - DNA, 17 bp, Artificial sequence
  Synthesized sequence
ctggcggggctggtgct

SEQ ID NO: 443 - DNA, 17 bp, Artificial sequence
  Synthesized sequence
atggcattggtgttgaa

SEQ ID NO: 444 - DNA, 17 bp, Artificial sequence
  Synthesized sequence
ctggcaaagctgctgcc

SEQ ID NO: 445 - DNA, 17 bp, Artificial sequence
  Synthesized sequence
gtggcgctgccgctgct

SEQ ID NO: 446 - DNA, 17 bp, Artificial sequence
  Synthesized sequence
ttggtagctaacttgct

SEQ ID NO: 447 - DNA, 17 bp, Artificial sequence
  Synthesized sequence
ccggcccggctgttgcc

SEQ ID NO: 448 - DNA, 17 bp, Artificial sequence
  Synthesized sequence
gtggcgccgaccatgct

SEQ ID NO: 449 - DNA, 17 bp, Artificial sequence
  Synthesized sequence
ttggcaggtataatgcg

SEQ ID NO: 450 - DNA, 17 bp, Artificial sequence
  Synthesized sequence
ctggcacgccgaaggca

SEQ ID NO: 451 - DNA, 17 bp, Artificial sequence
  Synthesized sequence
ttgacacccatcttgcc

SEQ ID NO: 452 - DNA, 17 bp, Artificial sequence
  Synthesized sequence
caggcacagggcctgct

SEQ ID NO: 453 - DNA, 17 bp, Artificial sequence
  Synthesized sequence
ctggaactttccttgcg

SEQ ID NO: 454 - DNA, 17 bp, Artificial sequence
  Synthesized sequence
ttgcgacgctgcttgct

SEQ ID NO: 455 - DNA, 17 bp, Artificial sequence
  Synthesized sequence
ctggcgctgaccgtgct

SEQ ID NO: 456 - DNA, 17 bp, Artificial sequence
  Synthesized sequence
gtgggacggacgtttca

SEQ ID NO: 457 - DNA, 17 bp, Artificial sequence
  Synthesized sequence
gaggcgcgctggttgct

SEQ ID NO: 458 - DNA, 17 bp, Artificial sequence
  Synthesized sequence
gaggcgccgcagttgct

SEQ ID NO: 459 - DNA, 17 bp, Artificial sequence
  Synthesized sequence
gtggccggcctggtgct

SEQ ID NO: 460 - DNA, 17 bp, Artificial sequence
  Synthesized sequence
ctggccagcatcctgca

SEQ ID NO: 461 - DNA, 17 bp, Artificial sequence
  Synthesized sequence
atggcgaggggattgcg

SEQ ID NO: 462 - DNA, 17 bp, Artificial sequence
  Synthesized sequence
ctcggacaattcttgca

SEQ ID NO: 463 - DNA, 17 bp, Artificial sequence
  Synthesized sequence
ctcggacaattcttgca

SEQ ID NO: 464 - DNA, 17 bp, Artificial sequence
  Synthesized sequence
gcggcctgcaacttgct

SEQ ID NO: 465 - DNA, 17 bp, Artificial sequence
  Synthesized sequence
ctggtctgggagttgct

SEQ ID NO: 466 - DNA, 17 bp, Artificial sequence
  Synthesized sequence
ctggtacaggcgttgat

SEQ ID NO: 467 - DNA, 17 bp, Artificial sequence
  Synthesized sequence
ctggcacggcatcagcg

SEQ ID NO: 468 - DNA, 17 bp, Artificial sequence
  Synthesized sequence
ctggcacggcatcagcg

SEQ ID NO: 469 - DNA, 17 bp, Artificial sequence
  Synthesized sequence
ctggcacgtgccgtcct

SEQ ID NO: 470 - DNA, 17 bp, Artificial sequence
  Synthesized sequence
tgggcacaaggcatgct

SEQ ID NO: 471 - DNA, 17 bp, Artificial sequence
  Synthesized sequence
ttcgaacagcaattgca

SEQ ID NO: 472 - DNA, 17 bp, Artificial sequence
  Synthesized sequence
gcggcctgcctgttgct

SEQ ID NO: 473 - DNA, 17 bp, Artificial sequence
  Synthesized sequence
ccggcacgcctgctgcc

SEQ ID NO: 474 - DNA, 17 bp, Artificial sequence
  Synthesized sequence
ctggaaccggaactgct

SEQ ID NO: 475 - DNA, 17 bp, Artificial sequence
  Synthesized sequence
ttggccctggccctgct

SEQ ID NO: 476 - DNA, 17 bp, Artificial sequence
  Synthesized sequence
ctggccggaatgctgct

SEQ ID NO: 477 - DNA, 17 bp, Artificial sequence
  Synthesized sequence
ctgggacgagccctgcg

SEQ ID NO: 478 - DNA, 17 bp, Artificial sequence
  Synthesized sequence
ggggcaggtcacttgcc

SEQ ID NO: 479 - DNA, 17 bp, Artificial sequence
  Synthesized sequence
atggcatgcagttggcc

SEQ ID NO: 480 - DNA, 17 bp, Artificial sequence
  Synthesized sequence
ggcgcacgatgcttgca

SEQ ID NO: 481 - DNA, 17 bp, Artificial sequence
  Synthesized sequence
ggcgcacgatgcttgca

SEQ ID NO: 482 - DNA, 17 bp, Artificial sequence
  Synthesized sequence
gtgccacgacaatggca

SEQ ID NO: 483 - DNA, 17 bp, Artificial sequence
  Synthesized sequence
gtgccacgacaatggca

SEQ ID NO: 484 - DNA, 17 bp, Artificial sequence
  Synthesized sequence
gtggcgcgggtcttccg

SEQ ID NO: 485 - DNA, 17 bp, Artificial sequence
  Synthesized sequence
ctggcacagcggctgga

SEQ ID NO: 486 - DNA, 17 bp, Artificial sequence
  Synthesized sequence
ctggcaggtcgactgcg

SEQ ID NO: 487 - DNA, 17 bp, Artificial sequence
  Synthesized sequence
ctggcacgcctgctgag

SEQ ID NO: 488 - DNA, 17 bp, Artificial sequence
  Synthesized sequence
ctggcagatcggtcgca

SEQ ID NO: 489 - DNA, 17 bp, Artificial sequence
  Synthesized sequence
tgtgcacggagtttgct

SEQ ID NO: 490 - DNA, 17 bp, Artificial sequence
  Synthesized sequence
atggcaggccagtcgcc

SEQ ID NO: 491 - DNA, 17 bp, Artificial sequence
  Synthesized sequence
ttgggaggcgatttgcc

SEQ ID NO: 492 - DNA, 17 bp, Artificial sequence
  Synthesized sequence
ctggcgcgacctatgcg

SEQ ID NO: 493 - DNA, 17 bp, Artificial sequence
  Synthesized sequence
ctggcacggctgctgtc

SEQ ID NO: 494 - DNA, 17 bp, Artificial sequence
  Synthesized sequence
ctggggctgcaattgct

SEQ ID NO: 495 - DNA, 17 bp, Artificial sequence
  Synthesized sequence
atggctcgttcctttct

SEQ ID NO: 496 - DNA, 17 bp, Artificial sequence
  Synthesized sequence
ctggaacgctacctgcg

SEQ ID NO: 497 - DNA, 17 bp, Artificial sequence
  Synthesized sequence
ctggtacccgacctgct

SEQ ID NO: 498 - DNA, 17 bp, Artificial sequence
  Synthesized sequence
ctggtagggcatctgca

SEQ ID NO: 499 - DNA, 17 bp, Artificial sequence
  Synthesized sequence
tcggcccgggtgttgcc

SEQ ID NO: 500 - DNA, 17 bp, Artificial sequence
  Synthesized sequence
ctgggactgagcctgct

SEQ ID NO: 501 - DNA, 17 bp, Artificial sequence
  Synthesized sequence
atggcattcggtatgca

SEQ ID NO: 502 - DNA, 17 bp, Artificial sequence
  Synthesized sequence
atggccaggctttcgct

SEQ ID NO: 503 - DNA, 17 bp, Artificial sequence
  Synthesized sequence
ctggcaccgttcctggt

SEQ ID NO: 504 - DNA, 17 bp, Artificial sequence
  Synthesized sequence
ctggcacccgcatcgcg

SEQ ID NO: 505 - DNA, 17 bp, Artificial sequence
  Synthesized sequence
caggcccgcctgttgcg

SEQ ID NO: 506 - DNA, 17 bp, Artificial sequence
  Synthesized sequence
ctggtacagagtttcct

SEQ ID NO: 507 - DNA, 17 bp, Artificial sequence
  Synthesized sequence
gtggccagcctgctgct

SEQ ID NO: 508 - DNA, 17 bp, Artificial sequence
  Synthesized sequence
ctggcacgcctgccgcc

SEQ ID NO: 509 - DNA, 17 bp, Artificial sequence
  Synthesized sequence
atggcctggacttcgct

SEQ ID NO: 510 - DNA, 17 bp, Artificial sequence
  Synthesized sequence
gtggcgcagaccttact

SEQ ID NO: 511 - DNA, 17 bp, Artificial sequence
  Synthesized sequence
ctggctgctcccttgct

SEQ ID NO: 512 - DNA, 17 bp, Artificial sequence
  Synthesized sequence
ctggcacgcttgttttt

SEQ ID NO: 513 - DNA, 17 bp, Artificial sequence
  Synthesized sequence
ctgacagcgcagttgct

SEQ ID NO: 514 - DNA, 17 bp, Artificial sequence
  Synthesized sequence
ctggcgggggtgctgct

SEQ ID NO: 515 - DNA, 17 bp, Artificial sequence
  Synthesized sequence
ctggcactctggtcgcc

SEQ ID NO: 516 - DNA, 17 bp, Artificial sequence
  Synthesized sequence
ctggcaccgccggcgct

SEQ ID NO: 517 - DNA, 17 bp, Artificial sequence
  Synthesized sequence
caggcgcacttgttgca

SEQ ID NO: 518 - DNA, 17 bp, Artificial sequence
  Synthesized sequence
ctggcacgcctggagcg

SEQ ID NO: 519 - DNA, 17 bp, Artificial sequence
  Synthesized sequence
ctggcgcagcaattcct

SEQ ID NO: 520 - DNA, 17 bp, Artificial sequence
  Synthesized sequence
tgggcaccgcatctgct

SEQ ID NO: 521 - DNA, 17 bp, Artificial sequence
  Synthesized sequence
ttggcacgaggcgttca

SEQ ID NO: 522 - DNA, 17 bp, Artificial sequence
  Synthesized sequence
ctggcctgcgccctgct

SEQ ID NO: 523 - DNA, 17 bp, Artificial sequence
  Synthesized sequence
ctggaactggtgctgca

SEQ ID NO: 524 - DNA, 17 bp, Artificial sequence
  Synthesized sequence
ttggcgcaagtgttgat

SEQ ID NO: 525 - DNA, 17 bp, Artificial sequence
  Synthesized sequence
atggccctggccctgct

SEQ ID NO: 526 - DNA, 17 bp, Artificial sequence
  Synthesized sequence
atggcgctgctgttggt

SEQ ID NO: 527 - DNA, 17 bp, Artificial sequence
  Synthesized sequence
tcggcacaggctgtgca

SEQ ID NO: 528 - DNA, 17 bp, Artificial sequence
  Synthesized sequence
ctggcctggccatggct

SEQ ID NO: 529 - DNA, 17 bp, Artificial sequence
  Synthesized sequence
ctggaactggccctgct

SEQ ID NO: 530 - DNA, 17 bp, Artificial sequence
  Synthesized sequence
atggcgccgttgtggct

SEQ ID NO: 531 - DNA, 17 bp, Artificial sequence
  Synthesized sequence
ctggcacaccctgagct

SEQ ID NO: 532 - DNA, 17 bp, Artificial sequence
  Synthesized sequence
ctggcgccatatctgct

SEQ ID NO: 533 - DNA, 17 bp, Artificial sequence
  Synthesized sequence
ctggctaaagtcttgcc

SEQ ID NO: 534 - DNA, 17 bp, Artificial sequence
  Synthesized sequence
ctggccgcggaattgca

SEQ ID NO: 535 - DNA, 17 bp, Artificial sequence
  Synthesized sequence
ctggccgtcaagttgca

SEQ ID NO: 536 - DNA, 17 bp, Artificial sequence
  Synthesized sequence
ctggaagggcaactgct

SEQ ID NO: 537 - DNA, 17 bp, Artificial sequence
  Synthesized sequence
gtggcgcgggacatgcc

SEQ ID NO: 538 - DNA, 17 bp, Artificial sequence
  Synthesized sequence
ctggccaaccagttgcg

SEQ ID NO: 539 - DNA, 17 bp, Artificial sequence
  Synthesized sequence
ctggcctgcgccctgct

SEQ ID NO: 540 - DNA, 17 bp, Artificial sequence
  Synthesized sequence
ttggcatagccattgtg

SEQ ID NO: 541 - DNA, 17 bp, Artificial sequence
  Synthesized sequence
gtcgcccggctgttgcg

SEQ ID NO: 542 - DNA, 17 bp, Artificial sequence
  Synthesized sequence
atggcgctgggcatgct

SEQ ID NO: 543 - DNA, 17 bp, Artificial sequence
  Synthesized sequence
atggcgcaggtatttca

SEQ ID NO: 544 - DNA, 17 bp, Artificial sequence
  Synthesized sequence
aagccacggagattgca

SEQ ID NO: 545 - DNA, 17 bp, Artificial sequence
  Synthesized sequence
ctggaacagcacctgcc

SEQ ID NO: 546 - DNA, 17 bp, Artificial sequence
  Synthesized sequence
caggcctggcagttgca

SEQ ID NO: 547 - DNA, 17 bp, Artificial sequence
  Synthesized sequence
ttggtatggttattggt

SEQ ID NO: 548 - DNA, 17 bp, Artificial sequence
  Synthesized sequence
gtggcgtgactattggt

SEQ ID NO: 549 - DNA, 17 bp, Artificial sequence
  Synthesized sequence
atggcgcatggcctgct

SEQ ID NO: 550 - DNA, 17 bp, Artificial sequence
  Synthesized sequence
agggcactccggttgcc

SEQ ID NO: 551 - DNA, 17 bp, Artificial sequence
  Synthesized sequence
gtggcaggcctccggct

SEQ ID NO: 552 - DNA, 17 bp, Artificial sequence
  Synthesized sequence
gtggcccgtcaattcca

SEQ ID NO: 553 - DNA, 17 bp, Artificial sequence
  Synthesized sequence
gtggcattgtgcttcca

SEQ ID NO: 554 - DNA, 17 bp, Artificial sequence
  Synthesized sequence
gtggccgggcagatgct

SEQ ID NO: 555 - DNA, 17 bp, Artificial sequence
  Synthesized sequence
ctgccctggctgttgct

SEQ ID NO: 556 - DNA, 17 bp, Artificial sequence
  Synthesized sequence
ttggcatgagcatttcg

SEQ ID NO: 557 - DNA, 17 bp, Artificial sequence
  Synthesized sequence
ctggcccatgtgatgca

SEQ ID NO: 558 - DNA, 17 bp, Artificial sequence
  Synthesized sequence
gcggcactgttgctgct

SEQ ID NO: 559 - DNA, 17 bp, Artificial sequence
  Synthesized sequence
gtagtacagcggttgca

SEQ ID NO: 560 - DNA, 17 bp, Artificial sequence
  Synthesized sequence
ctggcctgggcgctgct

SEQ ID NO: 561 - DNA, 17 bp, Artificial sequence
  Synthesized sequence
atggcgctgtcgctgct

SEQ ID NO: 562 - DNA, 17 bp, Artificial sequence
  Synthesized sequence
ctggccctgtgcctgct

SEQ ID NO: 563 - DNA, 17 bp, Artificial sequence
  Synthesized sequence
ctggcgctggtgctgca

SEQ ID NO: 564 - DNA, 17 bp, Artificial sequence
  Synthesized sequence
tgggctcgaatcttgcc

SEQ ID NO: 565 - DNA, 17 bp, Artificial sequence
  Synthesized sequence
ctggtctgcgccttgct

SEQ ID NO: 566 - DNA, 17 bp, Artificial sequence
  Synthesized sequence
atgggaagtcctttgcg

SEQ ID NO: 567 - DNA, 17 bp, Artificial sequence
  Synthesized sequence
ctggcgccggtgctgca

SEQ ID NO: 568 - DNA, 17 bp, Artificial sequence
  Synthesized sequence
ctggcgccggtgctgca

SEQ ID NO: 569 - DNA, 17 bp, Artificial sequence
  Synthesized sequence
gtggaacgtaccttcca

SEQ ID NO: 570 - DNA, 17 bp, Artificial sequence
  Synthesized sequence
atggctggccgattgcc

SEQ ID NO: 571 - DNA, 17 bp, Artificial sequence
  Synthesized sequence
atggcaaggtcctggcc

SEQ ID NO: 572 - DNA, 17 bp, Artificial sequence
  Synthesized sequence
ttggcccgattctagcg

SEQ ID NO: 573 - DNA, 17 bp, Artificial sequence
  Synthesized sequence
ctggccgaacagttgcg

SEQ ID NO: 574 - DNA, 17 bp, Artificial sequence
  Synthesized sequence
ggggcagggcgattgcc

SEQ ID NO: 575 - DNA, 17 bp, Artificial sequence
  Synthesized sequence
gtggcgcgtccgttcct

SEQ ID NO: 576 - DNA, 17 bp, Artificial sequence
  Synthesized sequence
atggccttgagcttgcg

SEQ ID NO: 577 - DNA, 17 bp, Artificial sequence
  Synthesized sequence
caggcgccgcaattgct

SEQ ID NO: 578 - DNA, 17 bp, Artificial sequence
  Synthesized sequence
ctggtactgtcgctgct

SEQ ID NO: 579 - DNA, 17 bp, Artificial sequence
  Synthesized sequence
atggcactgctggtgat

SEQ ID NO: 580 - DNA, 17 bp, Artificial sequence
  Synthesized sequence
atgccacggaaatagca

SEQ ID NO: 581 - DNA, 17 bp, Artificial sequence
  Synthesized sequence
ctggccggcctgctgct

SEQ ID NO: 582 - DNA, 17 bp, Artificial sequence
  Synthesized sequence
ctggtagggcggctgct

SEQ ID NO: 583 - DNA, 17 bp, Artificial sequence
  Synthesized sequence
gtggcgcgaggcctgcg

SEQ ID NO: 584 - DNA, 17 bp, Artificial sequence
  Synthesized sequence
ctggcgccgggcctgct

SEQ ID NO: 585 - DNA, 17 bp, Artificial sequence
  Synthesized sequence
atggcgcggcattcgcc

SEQ ID NO: 586 - DNA, 17 bp, Artificial sequence
  Synthesized sequence
ctggcgcgggagctgcc

SEQ ID NO: 587 - DNA, 17 bp, Artificial sequence
  Synthesized sequence
agggcaccggtcgtgct

SEQ ID NO: 588 - DNA, 17 bp, Artificial sequence
  Synthesized sequence
atggcctggctgttgta

SEQ ID NO: 589 - DNA, 17 bp, Artificial sequence
  Synthesized sequence
ctggaagccccgttgca

SEQ ID NO: 590 - DNA, 17 bp, Artificial sequence
  Synthesized sequence
gtggaatgcgacctgct

SEQ ID NO: 591 - DNA, 17 bp, Artificial sequence
  Synthesized sequence
ctggcacgcttcgggcg

SEQ ID NO: 592 - DNA, 17 bp, Artificial sequence
  Synthesized sequence
gtggccaggcgcctgca

SEQ ID NO: 593 - DNA, 17 bp, Artificial sequence
  Synthesized sequence
ctggaatggcggtcgct

SEQ ID NO: 594 - DNA, 17 bp, Artificial sequence
  Synthesized sequence
ctgacgcggctgttgcg

SEQ ID NO: 595 - DNA, 17 bp, Artificial sequence
  Synthesized sequence
aaggaacagggcttgca

SEQ ID NO: 596 - DNA, 17 bp, Artificial sequence
  Synthesized sequence
gtggcgcggtgcgtgcg

SEQ ID NO: 597 - DNA, 17 bp, Artificial sequence
  Synthesized sequence
gtggaacaaggctcgca

SEQ ID NO: 598 - DNA, 17 bp, Artificial sequence
  Synthesized sequence
ctggtgcatcagttgca

SEQ ID NO: 599 - DNA, 17 bp, Artificial sequence
  Synthesized sequence
caggaaccgcagttgct

SEQ ID NO: 600 - DNA, 17 bp, Artificial sequence
  Synthesized sequence
gtggcgccggagctgct

SEQ ID NO: 601 - DNA, 17 bp, Artificial sequence
  Synthesized sequence
tcggcaccgaccatgct

SEQ ID NO: 602 - DNA, 17 bp, Artificial sequence
  Synthesized sequence
gcggcgcggcaattgcg

SEQ ID NO: 603 - DNA, 17 bp, Artificial sequence
  Synthesized sequence
atgggattccttttgcg

SEQ ID NO: 604 - DNA, 17 bp, Artificial sequence
  Synthesized sequence
ctggccgagcagttgcg

SEQ ID NO: 605 - DNA, 17 bp, Artificial sequence
  Synthesized sequence
ctggcggaggtgttgcg

SEQ ID NO: 606 - DNA, 17 bp, Artificial sequence
  Synthesized sequence
ctggccggcatcctgca

SEQ ID NO: 607 - DNA, 17 bp, Artificial sequence
  Synthesized sequence
ctggcgcgcgagttcct

SEQ ID NO: 608 - DNA, 17 bp, Artificial sequence
  Synthesized sequence
ctggtttgctttttgca

SEQ ID NO: 609 - DNA, 17 bp, Artificial sequence
  Synthesized sequence
ctggaacaaggagtgca

SEQ ID NO: 610 - DNA, 17 bp, Artificial sequence
  Synthesized sequence
ctggcgcgggagctgcc

SEQ ID NO: 611 - DNA, 17 bp, Artificial sequence
  Synthesized sequence
ctggcccgcgtgctgcc

SEQ ID NO: 612 - DNA, 17 bp, Artificial sequence
  Synthesized sequence
atggcgggccttgtgct

SEQ ID NO: 613 - DNA, 17 bp, Artificial sequence
  Synthesized sequence
ttggcagatccgttgtt

SEQ ID NO: 614 - DNA, 17 bp, Artificial sequence
  Synthesized sequence
ctggccttcctgttgcg

SEQ ID NO: 615 - DNA, 17 bp, Artificial sequence
  Synthesized sequence
gtggaaccggaagtgct

SEQ ID NO: 616 - DNA, 17 bp, Artificial sequence
  Synthesized sequence
gtggcgcgcaacctgcc

SEQ ID NO: 617 - DNA, 17 bp, Artificial sequence
  Synthesized sequence
gtggcatcgcaggtgcc

SEQ ID NO: 618 - DNA, 17 bp, Artificial sequence
  Synthesized sequence
gtggcgctgccagtgct

SEQ ID NO: 619 - DNA, 17 bp, Artificial sequence
  Synthesized sequence
gtgccgcgcgtgttgca

SEQ ID NO: 620 - DNA, 17 bp, Artificial sequence
  Synthesized sequence
ttggccagtccgttgcg

SEQ ID NO: 621 - DNA, 17 bp, Artificial sequence
  Synthesized sequence
ccggcattcagattgct

SEQ ID NO: 622 - DNA, 17 bp, Artificial sequence
  Synthesized sequence
atggcaatggaatggca

SEQ ID NO: 623 - DNA, 17 bp, Artificial sequence
  Synthesized sequence
ctgccccaccctttgct

SEQ ID NO: 624 - DNA, 17 bp, Artificial sequence
  Synthesized sequence
ctgggccagttgttgcg

SEQ ID NO: 625 - DNA, 17 bp, Artificial sequence
  Synthesized sequence
ttggcaaaattcttgtg

SEQ ID NO: 626 - DNA, 17 bp, Artificial sequence
  Synthesized sequence
atcgcgccgctgttgca

SEQ ID NO: 627 - DNA, 17 bp, Artificial sequence
  Synthesized sequence
ccggcgctgcaattgca

SEQ ID NO: 628 - DNA, 17 bp, Artificial sequence
  Synthesized sequence
tcggcgtggtgcttgca

SEQ ID NO: 629 - DNA, 17 bp, Artificial sequence
  Synthesized sequence
gtggtcaggtaattgca

SEQ ID NO: 630 - DNA, 17 bp, Artificial sequence
  Synthesized sequence
gtggccgccgagttgca

SEQ ID NO: 631 - DNA, 17 bp, Artificial sequence
  Synthesized sequence
ctggacagctttttgca

SEQ ID NO: 632 - DNA, 17 bp, Artificial sequence
  Synthesized sequence
atgggcagccagttgct

SEQ ID NO: 633 - DNA, 17 bp, Artificial sequence
  Synthesized sequence
ctggaccggctctcgct

SEQ ID NO: 634 - DNA, 17 bp, Artificial sequence
  Synthesized sequence
ctgcctcggcttttgcc

SEQ ID NO: 635 - DNA, 17 bp, Artificial sequence
  Synthesized sequence
ctggcaggatattttcc

SEQ ID NO: 636 - DNA, 17 bp, Artificial sequence
  Synthesized sequence
ctggcgcggtcgatgcc

SEQ ID NO: 637 - DNA, 17 bp, Artificial sequence
  Synthesized sequence
gtggcagcgatggtgcg

SEQ ID NO: 638 - DNA, 17 bp, Artificial sequence
  Synthesized sequence
ttggcatcaccctggcg

SEQ ID NO: 639 - DNA, 17 bp, Artificial sequence
  Synthesized sequence
ttggcttacaaattgcc

SEQ ID NO: 640 - DNA, 17 bp, Artificial sequence
  Synthesized sequence
ttggtccagtccttgcc

SEQ ID NO: 641 - DNA, 17 bp, Artificial sequence
  Synthesized sequence
caggccgggcagttgct

SEQ ID NO: 642 - DNA, 17 bp, Artificial sequence
  Synthesized sequence
atggcacagcgctatct

SEQ ID NO: 643 - DNA, 17 bp, Artificial sequence
  Synthesized sequence
ctggtagaggtcctgct

SEQ ID NO: 644 - DNA, 17 bp, Artificial sequence
  Synthesized sequence
ctggcagcgcaactgcg

SEQ ID NO: 645 - DNA, 17 bp, Artificial sequence
  Synthesized sequence
ctggcgcgcctgttggc

SEQ ID NO: 646 - DNA, 17 bp, Artificial sequence
  Synthesized sequence
ttcggatggttcttgca

SEQ ID NO: 647 - DNA, 17 bp, Artificial sequence
  Synthesized sequence
ttgggcggggttttgca

SEQ ID NO: 648 - DNA, 17 bp, Artificial sequence
  Synthesized sequence
ctagcaccgctagtgca

SEQ ID NO: 649 - DNA, 17 bp, Artificial sequence
  Synthesized sequence
atggcgctgacttcgct

SEQ ID NO: 650 - DNA, 17 bp, Artificial sequence
  Synthesized sequence
ttggcactactggtgtt

SEQ ID NO: 651 - DNA, 17 bp, Artificial sequence
  Synthesized sequence
ctggcgctgacctggca

SEQ ID NO: 652 - DNA, 17 bp, Artificial sequence
  Synthesized sequence
gtggcacaggacatcca

SEQ ID NO: 653 - DNA, 17 bp, Artificial sequence
  Synthesized sequence
ttggcaggaaagtttcc

SEQ ID NO: 654 - DNA, 17 bp, Artificial sequence
  Synthesized sequence
atggcatgttcgtcgcc

SEQ ID NO: 655 - DNA, 17 bp, Artificial sequence
  Synthesized sequence
ctggccccaggcgtgct

SEQ ID NO: 656 - DNA, 17 bp, Artificial sequence
  Synthesized sequence
gtggccgagcacctgct

SEQ ID NO: 657 - DNA, 17 bp, Artificial sequence
  Synthesized sequence
gtggccgagcacctgct

SEQ ID NO: 658 - DNA, 17 bp, Artificial sequence
  Synthesized sequence
gtgtcgctgctattgct

SEQ ID NO: 659 - DNA, 17 bp, Artificial sequence
  Synthesized sequence
ctggccgccgggttgct

SEQ ID NO: 660 - DNA, 17 bp, Artificial sequence
  Synthesized sequence
gtggcgcgcgccatgcg

SEQ ID NO: 661 - DNA, 17 bp, Artificial sequence
  Synthesized sequence
atggcaaatccattgga

SEQ ID NO: 662 - DNA, 17 bp, Artificial sequence
  Synthesized sequence
ctggcatggcagctaca

SEQ ID NO: 663 - DNA, 17 bp, Artificial sequence
  Synthesized sequence
ctggcagtcgcctggct

SEQ ID NO: 664 - DNA, 17 bp, Artificial sequence
  Synthesized sequence
atggcccggctgccgct

SEQ ID NO: 665 - DNA, 17 bp, Artificial sequence
  Synthesized sequence
ttggcatagtcgttgag

SEQ ID NO: 666 - DNA, 17 bp, Artificial sequence
  Synthesized sequence
ttggtatagccctggct

SEQ ID NO: 667 - DNA, 17 bp, Artificial sequence
  Synthesized sequence
ctggcacaccgggagca

SEQ ID NO: 668 - DNA, 17 bp, Artificial sequence
  Synthesized sequence
ctggcacgggcgttcgt

SEQ ID NO: 669 - DNA, 17 bp, Artificial sequence
  Synthesized sequence
ctggcgcagcgcgtgcc

SEQ ID NO: 670 - DNA, 17 bp, Artificial sequence
  Synthesized sequence
ctgacccgctggttgca

SEQ ID NO: 671 - DNA, 17 bp, Artificial sequence
  Synthesized sequence
atggcatagcggtagcc

SEQ ID NO: 672 - DNA, 17 bp, Artificial sequence
  Synthesized sequence
gtggcgcatgtttcgca

SEQ ID NO: 673 - DNA, 17 bp, Artificial sequence
  Synthesized sequence
atggcctgcgcgctgct

SEQ ID NO: 674 - DNA, 17 bp, Artificial sequence
  Synthesized sequence
ccggcacgggtttcgcc

SEQ ID NO: 675 - DNA, 17 bp, Artificial sequence
  Synthesized sequence
tcgggatggcgattgct

SEQ ID NO: 676 - DNA, 17 bp, Artificial sequence
  Synthesized sequence
ctgccactgcgcctgct

SEQ ID NO: 677 - DNA, 17 bp, Artificial sequence
  Synthesized sequence
gtggcctacaacctgct

SEQ ID NO: 678 - DNA, 17 bp, Artificial sequence
  Synthesized sequence
ctggcacactggctgtt

SEQ ID NO: 679 - DNA, 17 bp, Artificial sequence
  Synthesized sequence
ctggcagggctgctggt

SEQ ID NO: 680 - DNA, 17 bp, Artificial sequence
  Synthesized sequence
ccggcctgccgcttgca

SEQ ID NO: 681 - DNA, 17 bp, Artificial sequence
  Synthesized sequence
ttgtcacggcggtttca

SEQ ID NO: 682 - DNA, 17 bp, Artificial sequence
  Synthesized sequence
ctggcgcgcaaggtgcc

SEQ ID NO: 683 - DNA, 17 bp, Artificial sequence
  Synthesized sequence
ctggagcgcgccttgcc

SEQ ID NO: 684 - DNA, 17 bp, Artificial sequence
  Synthesized sequence
ccggcaaagccattgcc

SEQ ID NO: 685 - DNA, 17 bp, Artificial sequence
  Synthesized sequence
acggctcggcgtttgcc

SEQ ID NO: 686 - DNA, 17 bp, Artificial sequence
  Synthesized sequence
ttggaactggaggtgca

SEQ ID NO: 687 - DNA, 17 bp, Artificial sequence
  Synthesized sequence
ctggtagggcaggtgca

SEQ ID NO: 688 - DNA, 17 bp, Artificial sequence
  Synthesized sequence
ctggcacgcctgctggc

SEQ ID NO: 689 - DNA, 17 bp, Artificial sequence
  Synthesized sequence
caggcactgtgcatgct

SEQ ID NO: 690 - DNA, 17 bp, Artificial sequence
  Synthesized sequence
gtgccacgttcgctgct

SEQ ID NO: 691 - DNA, 17 bp, Artificial sequence
  Synthesized sequence
ttggtatgcagcttgat

SEQ ID NO: 692 - DNA, 17 bp, Artificial sequence
  Synthesized sequence
atggcattgatcttgtc

SEQ ID NO: 693 - DNA, 17 bp, Artificial sequence
  Synthesized sequence
tcggcacgccgcatgcc

SEQ ID NO: 694 - DNA, 17 bp, Artificial sequence
  Synthesized sequence
gtggccggcatcatgca

SEQ ID NO: 695 - DNA, 17 bp, Artificial sequence
  Synthesized sequence
ctggcgggacctatgct

SEQ ID NO: 696 - DNA, 17 bp, Artificial sequence
  Synthesized sequence
ctggcgggacctatgct

SEQ ID NO: 697 - DNA, 17 bp, Artificial sequence
  Synthesized sequence
ctggcaatgcgcctgcg

SEQ ID NO: 698 - DNA, 17 bp, Artificial sequence
  Synthesized sequence
ctggccggagtgctgct

SEQ ID NO: 699 - DNA, 17 bp, Artificial sequence
  Synthesized sequence
ctggcttgcctgttcct

SEQ ID NO: 700 - DNA, 17 bp, Artificial sequence
  Synthesized sequence
ctggaacaggccctgcg

SEQ ID NO: 701 - DNA, 17 bp, Artificial sequence
  Synthesized sequence
ctggctccgcgctcgca

SEQ ID NO: 702 - DNA, 17 bp, Artificial sequence
  Synthesized sequence
ggggcacagagctagca

SEQ ID NO: 703 - DNA, 17 bp, Artificial sequence
  Synthesized sequence
ctggaacgcttcttccg

SEQ ID NO: 704 - DNA, 17 bp, Artificial sequence
  Synthesized sequence
ctgggccggcgcctgct

SEQ ID NO: 705 - DNA, 17 bp, Artificial sequence
  Synthesized sequence
ctggcgcgcgaggtgcg

SEQ ID NO: 706 - DNA, 17 bp, Artificial sequence
  Synthesized sequence
ttggccggactctggca

SEQ ID NO: 707 - DNA, 17 bp, Artificial sequence
  Synthesized sequence
gtggccaggtcgctgct

SEQ ID NO: 708 - DNA, 17 bp, Artificial sequence
  Synthesized sequence
ctgccagcgcagttgca

SEQ ID NO: 709 - DNA, 17 bp, Artificial sequence
  Synthesized sequence
gtggcacggccagggcc

SEQ ID NO: 710 - DNA, 17 bp, Artificial sequence
  Synthesized sequence
atggccagcatggtgct

SEQ ID NO: 711 - DNA, 17 bp, Artificial sequence
  Synthesized sequence
gtggaactggcgctgct

SEQ ID NO: 712 - DNA, 17 bp, Artificial sequence
  Synthesized sequence
ctggcctgggcctggca

SEQ ID NO: 713 - DNA, 17 bp, Artificial sequence
  Synthesized sequence
ctggcaggcatcccgct

SEQ ID NO: 714 - DNA, 17 bp, Artificial sequence
  Synthesized sequence
gtggcatgctccgcgct

SEQ ID NO: 715 - DNA, 17 bp, Artificial sequence
  Synthesized sequence
tgtgcacggttcttgcg

SEQ ID NO: 716 - DNA, 17 bp, Artificial sequence
  Synthesized sequence
ctggtatgccagtcgca

SEQ ID NO: 717 - DNA, 17 bp, Artificial sequence
  Synthesized sequence
gtggctcatggcgtgct

SEQ ID NO: 718 - DNA, 17 bp, Artificial sequence
  Synthesized sequence
ctggaacgaccgtggcc

SEQ ID NO: 719 - DNA, 17 bp, Artificial sequence
  Synthesized sequence
ctggtccgcctctggct

SEQ ID NO: 720 - DNA, 17 bp, Artificial sequence
  Synthesized sequence
atgttactgattttgca

SEQ ID NO: 721 - DNA, 17 bp, Artificial sequence
  Synthesized sequence
atcgcaaaggcgttgca

SEQ ID NO: 722 - DNA, 17 bp, Artificial sequence
  Synthesized sequence
gcggcaaggctggtgca

SEQ ID NO: 723 - DNA, 17 bp, Artificial sequence
  Synthesized sequence
ctgacccagggcttgca

SEQ ID NO: 724 - DNA, 17 bp, Artificial sequence
  Synthesized sequence
ctggcccgcgcactgcg

SEQ ID NO: 725 - DNA, 17 bp, Artificial sequence
  Synthesized sequence
ctggcacggcgagcgcc

SEQ ID NO: 726 - DNA, 17 bp, Artificial sequence
  Synthesized sequence
ctggcagcgcatctgcg

SEQ ID NO: 727 - DNA, 17 bp, Artificial sequence
  Synthesized sequence
gcggcacgcccctggcg

SEQ ID NO: 728 - DNA, 17 bp, Artificial sequence
  Synthesized sequence
ctggcgcaacgcctgcg

SEQ ID NO: 729 - DNA, 17 bp, Artificial sequence
  Synthesized sequence
ttggtatggcgatttct

SEQ ID NO: 730 - DNA, 17 bp, Artificial sequence
  Synthesized sequence
gtggccggcaacctgca

SEQ ID NO: 731 - DNA, 17 bp, Artificial sequence
  Synthesized sequence
cgggcgcgggtgttgcc

SEQ ID NO: 732 - DNA, 17 bp, Artificial sequence
  Synthesized sequence
gaggcgggggtcttgct

SEQ ID NO: 733 - DNA, 17 bp, Artificial sequence
  Synthesized sequence
ctgacccaggcattgct

SEQ ID NO: 734 - DNA, 17 bp, Artificial sequence
  Synthesized sequence
ctggaacaggccctgcg

SEQ ID NO: 735 - DNA, 17 bp, Artificial sequence
  Synthesized sequence
tgggcacgggcactgcg

SEQ ID NO: 736 - DNA, 17 bp, Artificial sequence
  Synthesized sequence
atgtcatggttgatgct

SEQ ID NO: 737 - DNA, 17 bp, Artificial sequence
  Synthesized sequence
ctggcgccggtcttcct

SEQ ID NO: 738 - DNA, 17 bp, Artificial sequence
  Synthesized sequence
atcgctcaggagttgct

SEQ ID NO: 739 - DNA, 17 bp, Artificial sequence
  Synthesized sequence
atggagccgtcgttgca

SEQ ID NO: 740 - DNA, 17 bp, Artificial sequence
  Synthesized sequence
gtggcgttgctcctgct

SEQ ID NO: 741 - DNA, 17 bp, Artificial sequence
  Synthesized sequence
ttggcgcgggcctggcc

SEQ ID NO: 742 - DNA, 17 bp, Artificial sequence
  Synthesized sequence
atggcccggcgcttccg

SEQ ID NO: 743 - DNA, 17 bp, Artificial sequence
  Synthesized sequence
cgggaacgatccttgcc

SEQ ID NO: 744 - DNA, 17 bp, Artificial sequence
  Synthesized sequence
ctggcaggttgcctgcc

SEQ ID NO: 745 - DNA, 17 bp, Artificial sequence
  Synthesized sequence
atggcaggactcatggt

SEQ ID NO: 746 - DNA, 17 bp, Artificial sequence
  Synthesized sequence
ctggcctacctggtgct

SEQ ID NO: 747 - DNA, 17 bp, Artificial sequence
  Synthesized sequence
ctggccggcatgctgca

SEQ ID NO: 748 - DNA, 17 bp, Artificial sequence
  Synthesized sequence
ctggttccctcgttgct

SEQ ID NO: 749 - DNA, 17 bp, Artificial sequence
  Synthesized sequence
gtggcgctggcggtgct

SEQ ID NO: 750 - DNA, 17 bp, Artificial sequence
  Synthesized sequence
ctggcgccgcgggtgca

SEQ ID NO: 751 - DNA, 17 bp, Artificial sequence
  Synthesized sequence
ctggctcatttcttcct

SEQ ID NO: 752 - DNA, 17 bp, Artificial sequence
  Synthesized sequence
gtggcgcagccgctgcg

SEQ ID NO: 753 - DNA, 17 bp, Artificial sequence
  Synthesized sequence
ctggccgggtgcctgct

SEQ ID NO: 754 - DNA, 17 bp, Artificial sequence
  Synthesized sequence
gtggcaagctcgtcgcc

SEQ ID NO: 755 - DNA, 17 bp, Artificial sequence
  Synthesized sequence
ccggcacggctcccgct

SEQ ID NO: 756 - DNA, 17 bp, Artificial sequence
  Synthesized sequence
ctggccctgtcgctgca

SEQ ID NO: 757 - DNA, 17 bp, Artificial sequence
  Synthesized sequence
gtgccgcggcgcttgcg

SEQ ID NO: 758 - DNA, 17 bp, Artificial sequence
  Synthesized sequence
ctggccgagggcttgcg

SEQ ID NO: 759 - DNA, 17 bp, Artificial sequence
  Synthesized sequence
gaggccctggagttgct

SEQ ID NO: 760 - DNA, 17 bp, Artificial sequence
  Synthesized sequence
ctggcgcgggcctcgcg

SEQ ID NO: 761 - DNA, 17 bp, Artificial sequence
  Synthesized sequence
ctggagcgcctgctgct

SEQ ID NO: 762 - DNA, 17 bp, Artificial sequence
  Synthesized sequence
ggggcgcaagaattgca

SEQ ID NO: 763 - DNA, 17 bp, Artificial sequence
  Synthesized sequence
atggcgctcagcctgct

SEQ ID NO: 764 - DNA, 17 bp, Artificial sequence
  Synthesized sequence
ccggcacgcaacctgcc

SEQ ID NO: 765 - DNA, 17 bp, Artificial sequence
  Synthesized sequence
ctggaaagcgacctgct

SEQ ID NO: 766 - DNA, 17 bp, Artificial sequence
  Synthesized sequence
ccggcgagcctgttgct

SEQ ID NO: 767 - DNA, 17 bp, Artificial sequence
  Synthesized sequence
atgccatgctggttgcg

SEQ ID NO: 768 - DNA, 17 bp, Artificial sequence
  Synthesized sequence
ttggcagggcgcacgct

SEQ ID NO: 769 - DNA, 17 bp, Artificial sequence
  Synthesized sequence
atggcgtgcgagctgct

SEQ ID NO: 770 - DNA, 17 bp, Artificial sequence
  Synthesized sequence
tcggcacggcgctggcc

SEQ ID NO: 771 - DNA, 17 bp, Artificial sequence
  Synthesized sequence
gtggaatgcctgttgta

SEQ ID NO: 772 - DNA, 17 bp, Artificial sequence
  Synthesized sequence
ctggcaccgaccacgca

SEQ ID NO: 773 - DNA, 17 bp, Artificial sequence
  Synthesized sequence
ttggcgaattttttgcg

SEQ ID NO: 774 - DNA, 17 bp, Artificial sequence
  Synthesized sequence
aaggcacgccctatgcc

SEQ ID NO: 775 - DNA, 17 bp, Artificial sequence
  Synthesized sequence
ctggcgcagcctctgcc

SEQ ID NO: 776 - DNA, 17 bp, Artificial sequence
  Synthesized sequence
ccggcacatgccctgca

SEQ ID NO: 777 - DNA, 17 bp, Artificial sequence
  Synthesized sequence
aaggcagggcaggtgct

SEQ ID NO: 778 - DNA, 17 bp, Artificial sequence
  Synthesized sequence
ttggcacacaaggcgca

SEQ ID NO: 779 - DNA, 17 bp, Artificial sequence
  Synthesized sequence
ttgccgcaacgcttgca

SEQ ID NO: 780 - DNA, 17 bp, Artificial sequence
  Synthesized sequence
gtgggccgcctgctgct

SEQ ID NO: 781 - DNA, 17 bp, Artificial sequence
  Synthesized sequence
caggcgcgccagttgcg

SEQ ID NO: 782 - DNA, 17 bp, Artificial sequence
  Synthesized sequence
ctggaacaggtggtgcg

SEQ ID NO: 783 - DNA, 17 bp, Artificial sequence
  Synthesized sequence
ccggcgctaccgttgct

SEQ ID NO: 784 - DNA, 17 bp, Artificial sequence
  Synthesized sequence
ctgtcaggaagcttgcg

SEQ ID NO: 785 - DNA, 17 bp, Artificial sequence
  Synthesized sequence
ctgtcaggaagcttgcg

SEQ ID NO: 786 - DNA, 17 bp, Artificial sequence
  Synthesized sequence
ctggaacgcgcggtgcg

SEQ ID NO: 787 - DNA, 17 bp, Artificial sequence
  Synthesized sequence
ttggcgcgcaactggcg

SEQ ID NO: 788 - DNA, 17 bp, Artificial sequence
  Synthesized sequence
ctggcacgactggttcg

SEQ ID NO: 789 - DNA, 17 bp, Artificial sequence
  Synthesized sequence
ctggcaggtctatttcg

SEQ ID NO: 790 - DNA, 17 bp, Artificial sequence
  Synthesized sequence
ctggccggaaacgtgct

SEQ ID NO: 791 - DNA, 17 bp, Artificial sequence
  Synthesized sequence
ctggcgcgccgctggcc

SEQ ID NO: 792 - DNA, 17 bp, Artificial sequence
  Synthesized sequence
ctggctcccctcttcct

SEQ ID NO: 793 - DNA, 17 bp, Artificial sequence
  Synthesized sequence
ctggccctggtatggca

SEQ ID NO: 794 - DNA, 17 bp, Artificial sequence
  Synthesized sequence
ctggaactggggctgct

SEQ ID NO: 795 - DNA, 17 bp, Artificial sequence
  Synthesized sequence
gtggctcgacaatggcg

SEQ ID NO: 796 - DNA, 17 bp, Artificial sequence
  Synthesized sequence
ctggcctggccttggca

SEQ ID NO: 797 - DNA, 17 bp, Artificial sequence
  Synthesized sequence
ctggcccagttgctgcc

SEQ ID NO: 798 - DNA, 17 bp, Artificial sequence
  Synthesized sequence
ctggcgcaggctttcct

SEQ ID NO: 799 - DNA, 17 bp, Artificial sequence
  Synthesized sequence
tttgcacgcaccttcca

SEQ ID NO: 800 - DNA, 17 bp, Artificial sequence
  Synthesized sequence
cgggcggggtttttgct

SEQ ID NO: 801 - DNA, 17 bp, Artificial sequence
  Synthesized sequence
ttggaaagccgcctgct

SEQ ID NO: 802 - DNA, 17 bp, Artificial sequence
  Synthesized sequence
ctggcctacgtcgtgct

SEQ ID NO: 803 - DNA, 17 bp, Artificial sequence
  Synthesized sequence
ctggcacgacgcgcgcc

SEQ ID NO: 804 - DNA, 17 bp, Artificial sequence
  Synthesized sequence
ctggccggcatgctgct

SEQ ID NO: 805 - DNA, 17 bp, Artificial sequence
  Synthesized sequence
ctggaactggtctggca

SEQ ID NO: 806 - DNA, 17 bp, Artificial sequence
  Synthesized sequence
atggcccgccaatcgcc

SEQ ID NO: 807 - DNA, 17 bp, Artificial sequence
  Synthesized sequence
gtggcataaggctttcc

SEQ ID NO: 808 - DNA, 17 bp, Artificial sequence
  Synthesized sequence
ctggaaggccgctcgct

SEQ ID NO: 809 - DNA, 17 bp, Artificial sequence
  Synthesized sequence
atggccagggccgtgca

SEQ ID NO: 810 - DNA, 17 bp, Artificial sequence
  Synthesized sequence
atcgcagcggcattgct

SEQ ID NO: 811 - DNA, 17 bp, Artificial sequence
  Synthesized sequence
ctggcacgctacgtgtc

SEQ ID NO: 812 - DNA, 17 bp, Artificial sequence
  Synthesized sequence
ctggcagatccactgcc

SEQ ID NO: 813 - DNA, 17 bp, Artificial sequence
  Synthesized sequence
ccggcacgccgctggcg

SEQ ID NO: 814 - DNA, 17 bp, Artificial sequence
  Synthesized sequence
gcggcccagaccttgcc

SEQ ID NO: 815 - DNA, 17 bp, Artificial sequence
  Synthesized sequence
ctggcacgaaacctccc

SEQ ID NO: 816 - DNA, 17 bp, Artificial sequence
  Synthesized sequence
ctggctagactgtggca

SEQ ID NO: 817 - DNA, 17 bp, Artificial sequence
  Synthesized sequence
ctggccccggaatggct

SEQ ID NO: 818 - DNA, 17 bp, Artificial sequence
  Synthesized sequence
ctgctacgggtgttgcc

SEQ ID NO: 819 - DNA, 17 bp, Artificial sequence
  Synthesized sequence
ctggaccgccgcctgct

SEQ ID NO: 820 - DNA, 17 bp, Artificial sequence
  Synthesized sequence
ctggaccgccgcctgct

SEQ ID NO: 821 - DNA, 17 bp, Artificial sequence
  Synthesized sequence
ctggcacgccgagtggg

SEQ ID NO: 822 - DNA, 17 bp, Artificial sequence
  Synthesized sequence
gtgggacgagcttggcg

SEQ ID NO: 823 - DNA, 17 bp, Artificial sequence
  Synthesized sequence
ccggccccctatttgct

SEQ ID NO: 824 - DNA, 17 bp, Artificial sequence
  Synthesized sequence
ctggcccgcgtgttccg

SEQ ID NO: 825 - DNA, 17 bp, Artificial sequence
  Synthesized sequence
aaggcacgaagagtgcc

SEQ ID NO: 826 - DNA, 17 bp, Artificial sequence
  Synthesized sequence
ctggcaccgccagttca

SEQ ID NO: 827 - DNA, 17 bp, Artificial sequence
  Synthesized sequence
gcggcaggcgtcgtgct

SEQ ID NO: 828 - DNA, 17 bp, Artificial sequence
  Synthesized sequence
atggtaacggaattgcg

SEQ ID NO: 829 - DNA, 17 bp, Artificial sequence
  Synthesized sequence
gcggcaccggactggct

SEQ ID NO: 830 - DNA, 17 bp, Artificial sequence
  Synthesized sequence
ctggcaggcatgctgtt

SEQ ID NO: 831 - DNA, 17 bp, Artificial sequence
  Synthesized sequence
ctggcgcaagtgctgcc

SEQ ID NO: 832 - DNA, 17 bp, Artificial sequence
  Synthesized sequence
attgcataggctttgcc

SEQ ID NO: 833 - DNA, 17 bp, Artificial sequence
  Synthesized sequence
ctggctcaccggtttca

SEQ ID NO: 834 - DNA, 17 bp, Artificial sequence
  Synthesized sequence
atggccaagccactgct

SEQ ID NO: 835 - DNA, 17 bp, Artificial sequence
  Synthesized sequence
ctggcccgcgacttccg

SEQ ID NO: 836 - DNA, 17 bp, Artificial sequence
  Synthesized sequence
ctggcccagggtctgcg

SEQ ID NO: 837 - DNA, 17 bp, Artificial sequence
  Synthesized sequence
agggcacgcccctggcg

SEQ ID NO: 838 - DNA, 17 bp, Artificial sequence
  Synthesized sequence
gtggcccggatcatgat

SEQ ID NO: 839 - DNA, 17 bp, Artificial sequence
  Synthesized sequence
ctggctggacatctgca

SEQ ID NO: 840 - DNA, 17 bp, Artificial sequence
  Synthesized sequence
ctggaacagggcctgcc

SEQ ID NO: 841 - DNA, 17 bp, Artificial sequence
  Synthesized sequence
gtggtgcgctacctgct

SEQ ID NO: 842 - DNA, 17 bp, Artificial sequence
  Synthesized sequence
gaggcactagtctagct

SEQ ID NO: 843 - DNA, 17 bp, Artificial sequence
  Synthesized sequence
ttggcccagaggatgcg

SEQ ID NO: 844 - DNA, 17 bp, Artificial sequence
  Synthesized sequence
atcgaacgcctgttgcc

SEQ ID NO: 845 - DNA, 17 bp, Artificial sequence
  Synthesized sequence
gtggtacggcacctggt

SEQ ID NO: 846 - DNA, 17 bp, Artificial sequence
  Synthesized sequence
gtggcgacacccttgcc

SEQ ID NO: 847 - DNA, 17 bp, Artificial sequence
  Synthesized sequence
gcggcacggtgctggcg

SEQ ID NO: 848 - DNA, 17 bp, Artificial sequence
  Synthesized sequence
aaggcacgctgactgcg

SEQ ID NO: 849 - DNA, 17 bp, Artificial sequence
  Synthesized sequence
gtggcgcaggagctgcg

SEQ ID NO: 850 - DNA, 17 bp, Artificial sequence
  Synthesized sequence
gtggcgcaggagctgcg

SEQ ID NO: 851 - DNA, 17 bp, Artificial sequence
  Synthesized sequence
gtgccaaggcttatgca

SEQ ID NO: 852 - DNA, 17 bp, Artificial sequence
  Synthesized sequence
atggaccgttcgttgcg

SEQ ID NO: 853 - DNA, 17 bp, Artificial sequence
  Synthesized sequence
ctggaaggcgaactgct

SEQ ID NO: 854 - DNA, 17 bp, Artificial sequence
  Synthesized sequence
atggccagcgccctgct

SEQ ID NO: 855 - DNA, 17 bp, Artificial sequence
  Synthesized sequence
ctggcactctgcctgat

SEQ ID NO: 856 - DNA, 17 bp, Artificial sequence
  Synthesized sequence
ttggaacgatgcttggc

SEQ ID NO: 857 - DNA, 17 bp, Artificial sequence
  Synthesized sequence
tgggcgcagcatttgcc

SEQ ID NO: 858 - DNA, 17 bp, Artificial sequence
  Synthesized sequence
gtggcacgcccggtggg

SEQ ID NO: 859 - DNA, 17 bp, Artificial sequence
  Synthesized sequence
ctgccgcccttcttgct

SEQ ID NO: 860 - DNA, 17 bp, Artificial sequence
  Synthesized sequence
ctggcctggttgctgcg

SEQ ID NO: 861 - DNA, 17 bp, Artificial sequence
  Synthesized sequence
ctggaacagcgctcgcc

SEQ ID NO: 862 - DNA, 17 bp, Artificial sequence
  Synthesized sequence
gcggcacgcccctggcc

SEQ ID NO: 863 - DNA, 17 bp, Artificial sequence
  Synthesized sequence
ctggcgcacgggtcgca

SEQ ID NO: 864 - DNA, 17 bp, Artificial sequence
  Synthesized sequence
gtggacgggtcgttgct

SEQ ID NO: 865 - DNA, 17 bp, Artificial sequence
  Synthesized sequence
gtggtagcggccttgcg

SEQ ID NO: 866 - DNA, 17 bp, Artificial sequence
  Synthesized sequence
ttggcacagccagcgcg

SEQ ID NO: 867 - DNA, 17 bp, Artificial sequence
  Synthesized sequence
ctggcacatcagcttca

SEQ ID NO: 868 - DNA, 17 bp, Artificial sequence
  Synthesized sequence
ctggcctagaccatgca

SEQ ID NO: 869 - DNA, 17 bp, Artificial sequence
  Synthesized sequence
cttgcccaggcattgca

SEQ ID NO: 870 - DNA, 17 bp, Artificial sequence
  Synthesized sequence
ctggaaaaggtcctgca

SEQ ID NO: 871 - DNA, 17 bp, Artificial sequence
  Synthesized sequence
ctgtcactactcttgat

SEQ ID NO: 872 - DNA, 17 bp, Artificial sequence
  Synthesized sequence
tcggcaccgcgctggca

SEQ ID NO: 873 - DNA, 17 bp, Artificial sequence
  Synthesized sequence
ctgccttgcctgttgca

SEQ ID NO: 874 - DNA, 17 bp, Artificial sequence
  Synthesized sequence
atggcaccgggaacgct

SEQ ID NO: 875 - DNA, 17 bp, Artificial sequence
  Synthesized sequence
gttgcatggttcttcct

SEQ ID NO: 876 - DNA, 17 bp, Artificial sequence
  Synthesized sequence
ctggcactgcaactgga

SEQ ID NO: 877 - DNA, 17 bp, Artificial sequence
  Synthesized sequence
ctggtaggcggcatgct

SEQ ID NO: 878 - DNA, 17 bp, Artificial sequence
  Synthesized sequence
ctggaaagccagatgca

SEQ ID NO: 879 - DNA, 17 bp, Artificial sequence
  Synthesized sequence
gtggcactcgacctgtt

SEQ ID NO: 880 - DNA, 17 bp, Artificial sequence
  Synthesized sequence
atggcgcgccggtcgcc

SEQ ID NO: 881 - DNA, 17 bp, Artificial sequence
  Synthesized sequence
acggcacaccacatgcc

SEQ ID NO: 882 - DNA, 17 bp, Artificial sequence
  Synthesized sequence
atggaactggagtcgct

SEQ ID NO: 883 - DNA, 17 bp, Artificial sequence
  Synthesized sequence
ccggcacgccgttggcg

SEQ ID NO: 884 - DNA, 17 bp, Artificial sequence
  Synthesized sequence
ctggaaatgccgttgcg

SEQ ID NO: 885 - DNA, 17 bp, Artificial sequence
  Synthesized sequence
ttgggaaggcattggca

SEQ ID NO: 886 - DNA, 17 bp, Artificial sequence
  Synthesized sequence
tcggtacgcatactgct

SEQ ID NO: 887 - DNA, 17 bp, Artificial sequence
  Synthesized sequence
gtggcggggttttcgca

SEQ ID NO: 888 - DNA, 17 bp, Artificial sequence
  Synthesized sequence
gcggcgccggctttgct

SEQ ID NO: 889 - DNA, 17 bp, Artificial sequence
  Synthesized sequence
ctggcccttggcctgct

SEQ ID NO: 890 - DNA, 17 bp, Artificial sequence
  Synthesized sequence
ctggccagccgcgtgca

SEQ ID NO: 891 - DNA, 17 bp, Artificial sequence
  Synthesized sequence
ttggccggccaatcgct

SEQ ID NO: 892 - DNA, 17 bp, Artificial sequence
  Synthesized sequence
tcggcatggcggttgtt

SEQ ID NO: 893 - DNA, 17 bp, Artificial sequence
  Synthesized sequence
atggcgttcaccttgcc

SEQ ID NO: 894 - DNA, 17 bp, Artificial sequence
  Synthesized sequence
ctgccagcggagttgca

SEQ ID NO: 895 - DNA, 17 bp, Artificial sequence
  Synthesized sequence
ctgccagcggagttgca

SEQ ID NO: 896 - DNA, 17 bp, Artificial sequence
  Synthesized sequence
ctggctggatatctgct

SEQ ID NO: 897 - DNA, 17 bp, Artificial sequence
  Synthesized sequence
ttcgcgtgcctgttgca

SEQ ID NO: 898 - DNA, 17 bp, Artificial sequence
  Synthesized sequence
gtggccgggcgctcgca

SEQ ID NO: 899 - DNA, 17 bp, Artificial sequence
  Synthesized sequence
tcggcactggggatgct

SEQ ID NO: 900 - DNA, 17 bp, Artificial sequence
  Synthesized sequence
gtggaagacgccttgcc

SEQ ID NO: 901 - DNA, 17 bp, Artificial sequence
  Synthesized sequence
gaggcgcggcgcctgct

SEQ ID NO: 902 - DNA, 17 bp, Artificial sequence
  Synthesized sequence
ctcggaccgccgttgct

SEQ ID NO: 903 - DNA, 17 bp, Artificial sequence
  Synthesized sequence
gtggcatcgaagtggcc

SEQ ID NO: 904 - DNA, 17 bp, Artificial sequence
  Synthesized sequence
gtggccggctcgctgct

SEQ ID NO: 905 - DNA, 17 bp, Artificial sequence
  Synthesized sequence
ctggccggcgagctgct

SEQ ID NO: 906 - DNA, 17 bp, Artificial sequence
  Synthesized sequence
ctggcgcaggccctgcg

SEQ ID NO: 907 - DNA, 17 bp, Artificial sequence
  Synthesized sequence
aggggaagatttttgct

SEQ ID NO: 908 - DNA, 17 bp, Artificial sequence
  Synthesized sequence
ttggtacgggcgttgtc

SEQ ID NO: 909 - DNA, 17 bp, Artificial sequence
  Synthesized sequence
gtggatcgctcgttgcg

SEQ ID NO: 910 - DNA, 17 bp, Artificial sequence
  Synthesized sequence
atggcagtctgttcgca

SEQ ID NO: 911 - DNA, 17 bp, Artificial sequence
  Synthesized sequence
aaggcgcgcggcttgcc

SEQ ID NO: 912 - DNA, 17 bp, Artificial sequence
  Synthesized sequence
gtggaagacctgctgct

SEQ ID NO: 913 - DNA, 17 bp, Artificial sequence
  Synthesized sequence
ctggccggcgagctgct

SEQ ID NO: 914 - DNA, 17 bp, Artificial sequence
  Synthesized sequence
ttggcaacggcattcct

SEQ ID NO: 915 - DNA, 17 bp, Artificial sequence
  Synthesized sequence
ttggcaacggcattcct

SEQ ID NO: 916 - DNA, 17 bp, Artificial sequence
  Synthesized sequence
ctggcccgtgaggtgcg

SEQ ID NO: 917 - DNA, 17 bp, Artificial sequence
  Synthesized sequence
atggcggactggttgcg

SEQ ID NO: 918 - DNA, 17 bp, Artificial sequence
  Synthesized sequence
ctgacctgggtgttgca

SEQ ID NO: 919 - DNA, 17 bp, Artificial sequence
  Synthesized sequence
gtggcgcgaccgtagcc

SEQ ID NO: 920 - DNA, 17 bp, Artificial sequence
  Synthesized sequence
ctggcgccgaccttcct

SEQ ID NO: 921 - DNA, 17 bp, Artificial sequence
  Synthesized sequence
ttggcgcggtggtggcg

SEQ ID NO: 922 - DNA, 17 bp, Artificial sequence
  Synthesized sequence
tcggcgcgaggcttgcg

SEQ ID NO: 923 - DNA, 17 bp, Artificial sequence
  Synthesized sequence
ctgggccgccgcctgct

SEQ ID NO: 924 - DNA, 17 bp, Artificial sequence
  Synthesized sequence
gtggctcagcaactgcc

SEQ ID NO: 925 - DNA, 17 bp, Artificial sequence
  Synthesized sequence
gtggtgcccgagttgca

SEQ ID NO: 926 - DNA, 17 bp, Artificial sequence
  Synthesized sequence
ctggggcgcctgctgct

SEQ ID NO: 927 - DNA, 17 bp, Artificial sequence
  Synthesized sequence
ctggcgcggctggcgca

SEQ ID NO: 928 - DNA, 17 bp, Artificial sequence
  Synthesized sequence
ctggcgcggatgccgct

SEQ ID NO: 929 - DNA, 17 bp, Artificial sequence
  Synthesized sequence
ctggcgcggatgccgct

SEQ ID NO: 930 - DNA, 17 bp, Artificial sequence
  Synthesized sequence
gttgcccggagattgcg

SEQ ID NO: 931 - DNA, 17 bp, Artificial sequence
  Synthesized sequence
ttcgcgcagttcttgcg

SEQ ID NO: 932 - DNA, 17 bp, Artificial sequence
  Synthesized sequence
cagggactggcgttgct

SEQ ID NO: 933 - DNA, 17 bp, Artificial sequence
  Synthesized sequence
agggcatagccgatgct

SEQ ID NO: 934 - DNA, 17 bp, Artificial sequence
  Synthesized sequence
ccggcacgctggctgcg

SEQ ID NO: 935 - DNA, 17 bp, Artificial sequence
  Synthesized sequence
ctggccttcctcgtgct

SEQ ID NO: 936 - DNA, 17 bp, Artificial sequence
  Synthesized sequence
atgccttgcattttgct

SEQ ID NO: 937 - DNA, 17 bp, Artificial sequence
  Synthesized sequence
ccggcacgcaggctgcg

SEQ ID NO: 938 - DNA, 17 bp, Artificial sequence
  Synthesized sequence
ttgccatgcgggttgcc

SEQ ID NO: 939 - DNA, 17 bp, Artificial sequence
  Synthesized sequence
atgccacggccagtgcg

SEQ ID NO: 940 - DNA, 17 bp, Artificial sequence
  Synthesized sequence
gtagaaaggatcttgca

SEQ ID NO: 941 - DNA, 17 bp, Artificial sequence
  Synthesized sequence
ctgaaatgcattttgca

SEQ ID NO: 942 - DNA, 17 bp, Artificial sequence
  Synthesized sequence
ctggccgagctggtgca

SEQ ID NO: 943 - DNA, 17 bp, Artificial sequence
  Synthesized sequence
ttggcgcgaagctggcc

SEQ ID NO: 944 - DNA, 17 bp, Artificial sequence
  Synthesized sequence
gtgccattgcacttgcg

SEQ ID NO: 945 - DNA, 17 bp, Artificial sequence
  Synthesized sequence
ctggctaggtgcatgca

SEQ ID NO: 946 - DNA, 17 bp, Artificial sequence
  Synthesized sequence
ctggcacggtccgttcc

SEQ ID NO: 947 - DNA, 17 bp, Artificial sequence
  Synthesized sequence
ctggtacgccgcttccc

SEQ ID NO: 948 - DNA, 17 bp, Artificial sequence
  Synthesized sequence
ctgggcggaaagttgca

SEQ ID NO: 949 - DNA, 17 bp, Artificial sequence
  Synthesized sequence
ctggcacgggccctacc

SEQ ID NO: 950 - DNA, 17 bp, Artificial sequence
  Synthesized sequence
attgctcggcggttgcg

SEQ ID NO: 951 - DNA, 17 bp, Artificial sequence
  Synthesized sequence
atggcgtgctcctggca

SEQ ID NO: 952 - DNA, 17 bp, Artificial sequence
  Synthesized sequence
gtggaaggcctgttggt

SEQ ID NO: 953 - DNA, 17 bp, Artificial sequence
  Synthesized sequence
ctggcttgctgggtgct

SEQ ID NO: 954 - DNA, 17 bp, Artificial sequence
  Synthesized sequence
ctggcgaacttcctgct

SEQ ID NO: 955 - DNA, 17 bp, Artificial sequence
  Synthesized sequence
ctggcagcctcgtttct

SEQ ID NO: 956 - DNA, 17 bp, Artificial sequence
  Synthesized sequence
ctggtccaccagttgcc

SEQ ID NO: 957 - DNA, 17 bp, Artificial sequence
  Synthesized sequence
ttgtcccgtctgttgcg

SEQ ID NO: 958 - DNA, 17 bp, Artificial sequence
  Synthesized sequence
ctgccgcaacgattgca

SEQ ID NO: 959 - DNA, 17 bp, Artificial sequence
  Synthesized sequence
ctggcacagttgaagcg

SEQ ID NO: 960 - DNA, 17 bp, Artificial sequence
  Synthesized sequence
ctggcacagttgaagcg

SEQ ID NO: 961 - DNA, 17 bp, Artificial sequence
  Synthesized sequence
gtggcccccggctcgct

SEQ ID NO: 962 - DNA, 17 bp, Artificial sequence
  Synthesized sequence
ctggtacggcgcgcgct

SEQ ID NO: 963 - DNA, 17 bp, Artificial sequence
  Synthesized sequence
ttggcgaccatcttgcc

SEQ ID NO: 964 - DNA, 17 bp, Artificial sequence
  Synthesized sequence
gttgccccagtgttgct

SEQ ID NO: 965 - DNA, 17 bp, Artificial sequence
  Synthesized sequence
ttgaccccggccttgct

SEQ ID NO: 966 - DNA, 17 bp, Artificial sequence
  Synthesized sequence
ctggaaccgccgttaca

SEQ ID NO: 967 - DNA, 17 bp, Artificial sequence
  Synthesized sequence
ctggcagggcctgggct

SEQ ID NO: 968 - DNA, 17 bp, Artificial sequence
  Synthesized sequence
ctggccggccagtcgct

SEQ ID NO: 969 - DNA, 17 bp, Artificial sequence
  Synthesized sequence
ctggcccgggcattggg

SEQ ID NO: 970 - DNA, 17 bp, Artificial sequence
  Synthesized sequence
tgggcatggtcatggct

SEQ ID NO: 971 - DNA, 17 bp, Artificial sequence
  Synthesized sequence
ctggagggacagttgca

SEQ ID NO: 972 - DNA, 17 bp, Artificial sequence
  Synthesized sequence
tcggcacggtaatcgcc

SEQ ID NO: 973 - DNA, 17 bp, Artificial sequence
  Synthesized sequence
gtgggacgagactttcg

SEQ ID NO: 974 - DNA, 17 bp, Artificial sequence
  Synthesized sequence
ctggccgagcatctgct

SEQ ID NO: 975 - DNA, 17 bp, Artificial sequence
  Synthesized sequence
atggcccagggcgtgcg

SEQ ID NO: 976 - DNA, 17 bp, Artificial sequence
  Synthesized sequence
ttggcacttgtcgcgct

SEQ ID NO: 977 - DNA, 17 bp, Artificial sequence
  Synthesized sequence
ctgccacggctatggcc

SEQ ID NO: 978 - DNA, 17 bp, Artificial sequence
  Synthesized sequence
ctggctcgaccgtttcg

SEQ ID NO: 979 - DNA, 17 bp, Artificial sequence
  Synthesized sequence
atggcaccatcgccgca

SEQ ID NO: 980 - DNA, 17 bp, Artificial sequence
  Synthesized sequence
atggcaggggtcatggt

SEQ ID NO: 981 - DNA, 17 bp, Artificial sequence
  Synthesized sequence
ctggccctggccttcct

SEQ ID NO: 982 - DNA, 17 bp, Artificial sequence
  Synthesized sequence
ctggcgggcctgttgat

SEQ ID NO: 983 - DNA, 17 bp, Artificial sequence
  Synthesized sequence
ctgggacgtgggtagca

SEQ ID NO: 984 - DNA, 17 bp, Artificial sequence
  Synthesized sequence
gtggcgctgggggtgca

SEQ ID NO: 985 - DNA, 17 bp, Artificial sequence
  Synthesized sequence
ctggcaccctgcgggct

SEQ ID NO: 986 - DNA, 17 bp, Artificial sequence
  Synthesized sequence
atggaacagccggtgcc

SEQ ID NO: 987 - DNA, 17 bp, Artificial sequence
  Synthesized sequence
gtggccggcgtgctgca

SEQ ID NO: 988 - DNA, 17 bp, Artificial sequence
  Synthesized sequence
ctggccagcgtgctgca

SEQ ID NO: 989 - DNA, 17 bp, Artificial sequence
  Synthesized sequence
cttgcaagatatttgcc

SEQ ID NO: 990 - DNA, 17 bp, Artificial sequence
  Synthesized sequence
cgggcatatccgttgcc

SEQ ID NO: 991 - DNA, 17 bp, Artificial sequence
  Synthesized sequence
ctggccagcgacgtgct

SEQ ID NO: 992 - DNA, 17 bp, Artificial sequence
  Synthesized sequence
tcggcacgcccctggcc

SEQ ID NO: 993 - DNA, 17 bp, Artificial sequence
  Synthesized sequence
ctggaaggctacgtgca

SEQ ID NO: 994 - DNA, 17 bp, Artificial sequence
  Synthesized sequence
ctggcgcaggaagtgcg

SEQ ID NO: 995 - DNA, 17 bp, Artificial sequence
  Synthesized sequence
tcgggacgaatcgtgct

SEQ ID NO: 996 - DNA, 17 bp, Artificial sequence
  Synthesized sequence
ctggccagcctgttcct

SEQ ID NO: 997 - DNA, 17 bp, Artificial sequence
  Synthesized sequence
ccggcacgtccagtgcg

SEQ ID NO: 998 - DNA, 17 bp, Artificial sequence
  Synthesized sequence
ctggaactggggtcgct

SEQ ID NO: 999 - DNA, 17 bp, Artificial sequence
  Synthesized sequence
ccggcacggccgttgtc

SEQ ID NO: 1000 - DNA, 17 bp, Artificial sequence
  Synthesized sequence
atggcacgctccgtccg

SEQ ID NO: 1001 - DNA, 17 bp, Artificial sequence
  Synthesized sequence
atggcacgctccgtccg

SEQ ID NO: 1002 - DNA, 17 bp, Artificial sequence
  Synthesized sequence
caggccaagctgttgct

SEQ ID NO: 1003 - DNA, 17 bp, Artificial sequence
  Synthesized sequence
ctggcaaccctctggcc

SEQ ID NO: 1004 - DNA, 17 bp, Artificial sequence
  Synthesized sequence
ctgggatgccttctgcg

SEQ ID NO: 1005 - DNA, 17 bp, Artificial sequence
  Synthesized sequence
ctggtagcgcagttgcc

SEQ ID NO: 1006 - DNA, 17 bp, Artificial sequence
  Synthesized sequence
aaggcacggcacttccc

SEQ ID NO: 1007 - DNA, 17 bp, Artificial sequence
  Synthesized sequence
atggggcctccgttgct

SEQ ID NO: 1008 - DNA, 17 bp, Artificial sequence
  Synthesized sequence
gcggcacggtgaatgcc

SEQ ID NO: 1009 - DNA, 17 bp, Artificial sequence
  Synthesized sequence
ctggtcggcgccttgca

SEQ ID NO: 1010 - DNA, 17 bp, Artificial sequence
  Synthesized sequence
ccggcgcgggcattgcc

SEQ ID NO: 1011 - DNA, 17 bp, Artificial sequence
  Synthesized sequence
gtggcaaggcgcgtgaa

SEQ ID NO: 1012 - DNA, 17 bp, Artificial sequence
  Synthesized sequence
ctggggcgcctgctgct

SEQ ID NO: 1013 - DNA, 17 bp, Artificial sequence
  Synthesized sequence
ttgcccctacagttgct

SEQ ID NO: 1014 - DNA, 17 bp, Artificial sequence
  Synthesized sequence
ctggtacggctgaagca

SEQ ID NO: 1015 - DNA, 17 bp, Artificial sequence
  Synthesized sequence
ctggcattctagctgcg

SEQ ID NO: 1016 - DNA, 17 bp, Artificial sequence
  Synthesized sequence
gtggcggaaggcttgcc

SEQ ID NO: 1017 - DNA, 17 bp, Artificial sequence
  Synthesized sequence
atggcttcgctgctgct

SEQ ID NO: 1018 - DNA, 17 bp, Artificial sequence
  Synthesized sequence
gcggcactgcgctagca

SEQ ID NO: 1019 - DNA, 17 bp, Artificial sequence
  Synthesized sequence
taggcactatcggtgct

SEQ ID NO: 1020 - DNA, 17 bp, Artificial sequence
  Synthesized sequence
atggcggcgatgttgcc

SEQ ID NO: 1021 - DNA, 17 bp, Artificial sequence
  Synthesized sequence
ctggctctggcgtcgct

SEQ ID NO: 1022 - DNA, 17 bp, Artificial sequence
  Synthesized sequence
acggcacgggcctggcc

SEQ ID NO: 1023 - DNA, 17 bp, Artificial sequence
  Synthesized sequence
gtggaacgggtccggct

SEQ ID NO: 1024 - DNA, 17 bp, Artificial sequence
  Synthesized sequence
cgggcaaaaaaattgcg

SEQ ID NO: 1025 - DNA, 17 bp, Artificial sequence
  Synthesized sequence
tgggcgtggatcttgcg

SEQ ID NO: 1026 - DNA, 17 bp, Artificial sequence
  Synthesized sequence
ctggcgcagctgtggcc

SEQ ID NO: 1027 - DNA, 17 bp, Artificial sequence
  Synthesized sequence
ctggccggccgtgtgct

SEQ ID NO: 1028 - DNA, 17 bp, Artificial sequence
  Synthesized sequence
ctgtcctgattattgca

SEQ ID NO: 1029 - DNA, 17 bp, Artificial sequence
  Synthesized sequence
gtggaacagacgctgcc

SEQ ID NO: 1030 - DNA, 17 bp, Artificial sequence
  Synthesized sequence
gtcgcgccgcccttgca

SEQ ID NO: 1031 - DNA, 17 bp, Artificial sequence
  Synthesized sequence
ttgtcgctgtacttgct

SEQ ID NO: 1032 - DNA, 17 bp, Artificial sequence
  Synthesized sequence
atggcatcgtagtggcg

SEQ ID NO: 1033 - DNA, 17 bp, Artificial sequence
  Synthesized sequence
tttgcgctactgttgca

SEQ ID NO: 1034 - DNA, 17 bp, Artificial sequence
  Synthesized sequence
gtggcaggaattcggca

SEQ ID NO: 1035 - DNA, 17 bp, Artificial sequence
  Synthesized sequence
acggcacgcgactcgcg

SEQ ID NO: 1036 - DNA, 17 bp, Artificial sequence
  Synthesized sequence
tcggcgggagttttgct

SEQ ID NO: 1037 - DNA, 17 bp, Artificial sequence
  Synthesized sequence
ctgtcaggcgccttgcc

SEQ ID NO: 1038 - DNA, 17 bp, Artificial sequence
  Synthesized sequence
ctggcacactactccca

SEQ ID NO: 1039 - DNA, 17 bp, Artificial sequence
  Synthesized sequence
ctggcacactactccca

SEQ ID NO: 1040 - DNA, 17 bp, Artificial sequence
  Synthesized sequence
ctggcccaggtagtgcc

SEQ ID NO: 1041 - DNA, 17 bp, Artificial sequence
  Synthesized sequence
gtggaactcgattcgct

SEQ ID NO: 1042 - DNA, 17 bp, Artificial sequence
  Synthesized sequence
ctggcgcacgttgtgcg

SEQ ID NO: 1043 - DNA, 17 bp, Artificial sequence
  Synthesized sequence
atggcacggcgactacg

SEQ ID NO: 1044 - DNA, 17 bp, Artificial sequence
  Synthesized sequence
gtggtgcggtccgtgca

SEQ ID NO: 1045 - DNA, 17 bp, Artificial sequence
  Synthesized sequence
gtggcacggagagtggg

SEQ ID NO: 1046 - DNA, 17 bp, Artificial sequence
  Synthesized sequence
ctggcgccacgatggca

SEQ ID NO: 1047 - DNA, 17 bp, Artificial sequence
  Synthesized sequence
gtggcagaggggatgcc

SEQ ID NO: 1048 - DNA, 17 bp, Artificial sequence
  Synthesized sequence
atggccaggtcgctgca

SEQ ID NO: 1049 - DNA, 17 bp, Artificial sequence
  Synthesized sequence
atggaaagcgccgtgct

SEQ ID NO: 1050 - DNA, 17 bp, Artificial sequence
  Synthesized sequence
attgcacgccgcatgcc

SEQ ID NO: 1051 - DNA, 17 bp, Artificial sequence
  Synthesized sequence
ccggcaagcctttttct

SEQ ID NO: 1052 - DNA, 17 bp, Artificial sequence
  Synthesized sequence
ctcgtacggttcgtgca

SEQ ID NO: 1053 - DNA, 17 bp, Artificial sequence
  Synthesized sequence
gtggcccgtcgcttccg

SEQ ID NO: 1054 - DNA, 17 bp, Artificial sequence
  Synthesized sequence
ctggcggggagcttgaa

SEQ ID NO: 1055 - DNA, 17 bp, Artificial sequence
  Synthesized sequence
gcggcgcgggtgatgct

SEQ ID NO: 1056 - DNA, 17 bp, Artificial sequence
  Synthesized sequence
gtggcaccatgggcgca

SEQ ID NO: 1057 - DNA, 17 bp, Artificial sequence
  Synthesized sequence
ctggcaacagggtttct

SEQ ID NO: 1058 - DNA, 17 bp, Artificial sequence
  Synthesized sequence
ctggcaacagggtttct

SEQ ID NO: 1059 - DNA, 17 bp, Artificial sequence
  Synthesized sequence
ctggaactggacctgcg

SEQ ID NO: 1060 - DNA, 17 bp, Artificial sequence
  Synthesized sequence
ccggcacatggagtgca

SEQ ID NO: 1061 - DNA, 17 bp, Artificial sequence
  Synthesized sequence
ctggcgcggcctctgtt

SEQ ID NO: 1062 - DNA, 17 bp, Artificial sequence
  Synthesized sequence
ctggcgcggcgcgggct

SEQ ID NO: 1063 - DNA, 17 bp, Artificial sequence
  Synthesized sequence
ttggcgcgctccttggc

SEQ ID NO: 1064 - DNA, 17 bp, Artificial sequence
  Synthesized sequence
gtggcggcgctgctgct

SEQ ID NO: 1065 - DNA, 17 bp, Artificial sequence
  Synthesized sequence
gtcgccagcctgttgct

SEQ ID NO: 1066 - DNA, 17 bp, Artificial sequence
  Synthesized sequence
atggccagggcgttgat

SEQ ID NO: 1067 - DNA, 17 bp, Artificial sequence
  Synthesized sequence
ctggacctgaccttgcg

SEQ ID NO: 1068 - DNA, 17 bp, Artificial sequence
  Synthesized sequence
ctggccttcgtcctgct

SEQ ID NO: 1069 - DNA, 17 bp, Artificial sequence
  Synthesized sequence
ccggcacgtcctgtgcc

SEQ ID NO: 1070 - DNA, 17 bp, Artificial sequence
  Synthesized sequence
gcggcacaggacgtgcc

SEQ ID NO: 1071 - DNA, 17 bp, Artificial sequence
  Synthesized sequence
ctggcgcgggtccagca

SEQ ID NO: 1072 - DNA, 17 bp, Artificial sequence
  Synthesized sequence
aaggcccgggacctgct

SEQ ID NO: 1073 - DNA, 17 bp, Artificial sequence
  Synthesized sequence
cgggcacgattcacgct

SEQ ID NO: 1074 - DNA, 17 bp, Artificial sequence
  Synthesized sequence
ggggcacggagattggg

SEQ ID NO: 1075 - DNA, 17 bp, Artificial sequence
  Synthesized sequence
gtggaaagcatgttcct

SEQ ID NO: 1076 - DNA, 17 bp, Artificial sequence
  Synthesized sequence
gtggccggatcatcgct

SEQ ID NO: 1077 - DNA, 17 bp, Artificial sequence
  Synthesized sequence
ctggcaccggcgacgca

SEQ ID NO: 1078 - DNA, 17 bp, Artificial sequence
  Synthesized sequence
atcgcctacctgttgct

SEQ ID NO: 1079 - DNA, 17 bp, Artificial sequence
  Synthesized sequence
ccggaacgggtactgct

SEQ ID NO: 1080 - DNA, 17 bp, Artificial sequence
  Synthesized sequence
tcggcacgcttattgac

SEQ ID NO: 1081 - DNA, 17 bp, Artificial sequence
  Synthesized sequence
ctggaccgcaccctgca

SEQ ID NO: 1082 - DNA, 17 bp, Artificial sequence
  Synthesized sequence
tcggcgcggttcttgat

SEQ ID NO: 1083 - DNA, 17 bp, Artificial sequence
  Synthesized sequence
taggcaaggcgctcgca

SEQ ID NO: 1084 - DNA, 17 bp, Artificial sequence
  Synthesized sequence
cgggcatgcagatggct

SEQ ID NO: 1085 - DNA, 17 bp, Artificial sequence
  Synthesized sequence
ctggagcgcaccgtgct

SEQ ID NO: 1086 - DNA, 17 bp, Artificial sequence
  Synthesized sequence
ctggcggcgctgctgct

SEQ ID NO: 1087 - DNA, 17 bp, Artificial sequence
  Synthesized sequence
ctgccatgaccatcgct

SEQ ID NO: 1088 - DNA, 17 bp, Artificial sequence
  Synthesized sequence
ttgtcacgccggctgcc

SEQ ID NO: 1089 - DNA, 17 bp, Artificial sequence
  Synthesized sequence
ctggaatgaaccctgcg

SEQ ID NO: 1090 - DNA, 17 bp, Artificial sequence
  Synthesized sequence
gccgcacgccagttgcg

SEQ ID NO: 1091 - DNA, 17 bp, Artificial sequence
  Synthesized sequence
ctggttcgccgagtgct

SEQ ID NO: 1092 - DNA, 17 bp, Artificial sequence
  Synthesized sequence
ctggcacccagcctgga

SEQ ID NO: 1093 - DNA, 17 bp, Artificial sequence
  Synthesized sequence
gcggcagcggccttgcg

SEQ ID NO: 1094 - DNA, 17 bp, Artificial sequence
  Synthesized sequence
gtggagcaagcattgcg

SEQ ID NO: 1095 - DNA, 17 bp, Artificial sequence
  Synthesized sequence
atggtgcacatcatgct

SEQ ID NO: 1096 - DNA, 17 bp, Artificial sequence
  Synthesized sequence
atggtacccagatggca

SEQ ID NO: 1097 - DNA, 17 bp, Artificial sequence
  Synthesized sequence
ctggcaggccatatcct

SEQ ID NO: 1098 - DNA, 17 bp, Artificial sequence
  Synthesized sequence
gtggcacgggcctggtc

SEQ ID NO: 1099 - DNA, 17 bp, Artificial sequence
  Synthesized sequence
caggcgcggcgggtgct

SEQ ID NO: 1100 - DNA, 17 bp, Artificial sequence
  Synthesized sequence
ctggcgcggatcgagca

SEQ ID NO: 1101 - DNA, 17 bp, Artificial sequence
  Synthesized sequence
gtggcaggtgattggcc

SEQ ID NO: 1102 - DNA, 17 bp, Artificial sequence
  Synthesized sequence
gtggaactacgcctgcg

SEQ ID NO: 1103 - DNA, 17 bp, Artificial sequence
  Synthesized sequence
ctggaaaacgtcatgct

SEQ ID NO: 1104 - DNA, 17 bp, Artificial sequence
  Synthesized sequence
ttcgcgctggccttgca

SEQ ID NO: 1105 - DNA, 17 bp, Artificial sequence
  Synthesized sequence
ctggcgggcctgttcca

SEQ ID NO: 1106 - DNA, 17 bp, Artificial sequence
  Synthesized sequence
ccgggatgctggttgca

SEQ ID NO: 1107 - DNA, 17 bp, Artificial sequence
  Synthesized sequence
gtggcacagcggctggg

SEQ ID NO: 1108 - DNA, 17 bp, Artificial sequence
  Synthesized sequence
ccggcacggcggttacc

SEQ ID NO: 1109 - DNA, 17 bp, Artificial sequence
  Synthesized sequence
gtggcgcaggtgttgag

SEQ ID NO: 1110 - DNA, 17 bp, Artificial sequence
  Synthesized sequence
atggaactccatttcca

SEQ ID NO: 1111 - DNA, 17 bp, Artificial sequence
  Synthesized sequence
ctggcaggacgcctgga

SEQ ID NO: 1112 - DNA, 17 bp, Artificial sequence
  Synthesized sequence
atggtgcgcagcgtgct

SEQ ID NO: 1113 - DNA, 17 bp, Artificial sequence
  Synthesized sequence
ctgggccagcatctgct

SEQ ID NO: 1114 - DNA, 17 bp, Artificial sequence
  Synthesized sequence
ctggctggccgctcgca

SEQ ID NO: 1115 - DNA, 17 bp, Artificial sequence
  Synthesized sequence
ctggcgaagaagatgct

SEQ ID NO: 1116 - DNA, 17 bp, Artificial sequence
  Synthesized sequence
atggctttggtcatgct

SEQ ID NO: 1117 - DNA, 17 bp, Artificial sequence
  Synthesized sequence
gtggcacgcggattata

SEQ ID NO: 1118 - DNA, 17 bp, Artificial sequence
  Synthesized sequence
aaggcattgaacctgct

SEQ ID NO: 1119 - DNA, 17 bp, Artificial sequence
  Synthesized sequence
ctcgcctgccatttgca

SEQ ID NO: 1120 - DNA, 17 bp, Artificial sequence
  Synthesized sequence
ccggcacggtggttgtc

SEQ ID NO: 1121 - DNA, 17 bp, Artificial sequence
  Synthesized sequence
ctggcgttcaggttgcg

SEQ ID NO: 1122 - DNA, 17 bp, Artificial sequence
  Synthesized sequence
ttggcactggggatggt

SEQ ID NO: 1123 - DNA, 17 bp, Artificial sequence
  Synthesized sequence
ccggcccagctgctgct

SEQ ID NO: 1124 - DNA, 17 bp, Artificial sequence
  Synthesized sequence
gaggatcggaccttgct

SEQ ID NO: 1125 - DNA, 17 bp, Artificial sequence
  Synthesized sequence
gtggccaaatacatgct

SEQ ID NO: 1126 - DNA, 17 bp, Artificial sequence
  Synthesized sequence
gtggccaaatacatgct

SEQ ID NO: 1127 - DNA, 17 bp, Artificial sequence
  Synthesized sequence
cagggacggaccctgca

SEQ ID NO: 1128 - DNA, 17 bp, Artificial sequence
  Synthesized sequence
cagggacggaccctgca

SEQ ID NO: 1129 - DNA, 17 bp, Artificial sequence
  Synthesized sequence
ctggcccgtccatcgcc

SEQ ID NO: 1130 - DNA, 17 bp, Artificial sequence
  Synthesized sequence
tcggcacgctgatcgcg

SEQ ID NO: 1131 - DNA, 17 bp, Artificial sequence
  Synthesized sequence
ccggcgggtctgttgca

SEQ ID NO: 1132 - DNA, 17 bp, Artificial sequence
  Synthesized sequence
gaggcacggcggtttcc

SEQ ID NO: 1133 - DNA, 17 bp, Artificial sequence
  Synthesized sequence
ctggaatgcgcctggca

SEQ ID NO: 1134 - DNA, 17 bp, Artificial sequence
  Synthesized sequence
gtgggaaggtgcttggt

SEQ ID NO: 1135 - DNA, 17 bp, Artificial sequence
  Synthesized sequence
ctggaaaacgtcatgct

SEQ ID NO: 1136 - DNA, 17 bp, Artificial sequence
  Synthesized sequence
atggcatgaaggtcggt

SEQ ID NO: 1137 - DNA, 17 bp, Artificial sequence
  Synthesized sequence
ccgccacaagccttgca

SEQ ID NO: 1138 - DNA, 17 bp, Artificial sequence
  Synthesized sequence
ttgatacgacggttgcc

SEQ ID NO: 1139 - DNA, 17 bp, Artificial sequence
  Synthesized sequence
ctggcaggcgcattccc

SEQ ID NO: 1140 - DNA, 17 bp, Artificial sequence
  Synthesized sequence
ctgacgctggacttgca

SEQ ID NO: 1141 - DNA, 17 bp, Artificial sequence
  Synthesized sequence
gtggaagaagacctgct

SEQ ID NO: 1142 - DNA, 17 bp, Artificial sequence
  Synthesized sequence
atgggacgactcctgga

SEQ ID NO: 1143 - DNA, 17 bp, Artificial sequence
  Synthesized sequence
ccggcactcgcctcgct

SEQ ID NO: 1144 - DNA, 17 bp, Artificial sequence
  Synthesized sequence
ttggcccgccggttccg

SEQ ID NO: 1145 - DNA, 17 bp, Artificial sequence
  Synthesized sequence
ctggaacgccatccgct

SEQ ID NO: 1146 - DNA, 17 bp, Artificial sequence
  Synthesized sequence
gtcgcaggcatgctgct

SEQ ID NO: 1147 - DNA, 17 bp, Artificial sequence
  Synthesized sequence
ccggctcgcctgctgct

SEQ ID NO: 1148 - DNA, 17 bp, Artificial sequence
  Synthesized sequence
ctggaaccagatttcct

SEQ ID NO: 1149 - DNA, 17 bp, Artificial sequence
  Synthesized sequence
atggcagggcactcgaa

SEQ ID NO: 1150 - DNA, 17 bp, Artificial sequence
  Synthesized sequence
ccggaaagaagtttgct

SEQ ID NO: 1151 - DNA, 17 bp, Artificial sequence
  Synthesized sequence
ctggcccggcaactggt

SEQ ID NO: 1152 - DNA, 17 bp, Artificial sequence
  Synthesized sequence
ccggccgagcagttgct

SEQ ID NO: 1153 - DNA, 17 bp, Artificial sequence
  Synthesized sequence
atggcatggtgctatct

SEQ ID NO: 1154 - DNA, 17 bp, Artificial sequence
  Synthesized sequence
caggcatgaagttcgca

SEQ ID NO: 1155 - DNA, 17 bp, Artificial sequence
  Synthesized sequence
ctggccaagggcctgct

SEQ ID NO: 1156 - DNA, 17 bp, Artificial sequence
  Synthesized sequence
cttgcatggatattcct

SEQ ID NO: 1157 - DNA, 17 bp, Artificial sequence
  Synthesized sequence
gcggcaacacgcttgcc

SEQ ID NO: 1158 - DNA, 17 bp, Artificial sequence
  Synthesized sequence
ccggcgcagccgttgcc

SEQ ID NO: 1159 - DNA, 17 bp, Artificial sequence
  Synthesized sequence
ctggcccagctcctggt

SEQ ID NO: 1160 - DNA, 17 bp, Artificial sequence
  Synthesized sequence
ctggcagcgccgtcgcg

SEQ ID NO: 1161 - DNA, 17 bp, Artificial sequence
  Synthesized sequence
ctggaagcacggttgcg

SEQ ID NO: 1162 - DNA, 17 bp, Artificial sequence
  Synthesized sequence
atggcgccgccgatgcg

SEQ ID NO: 1163 - DNA, 17 bp, Artificial sequence
  Synthesized sequence
ctggcctggttctcgcc

SEQ ID NO: 1164 - DNA, 17 bp, Artificial sequence
  Synthesized sequence
gcggaacggcggatgct

SEQ ID NO: 1165 - DNA, 17 bp, Artificial sequence
  Synthesized sequence
tcggatcggcgcttgca

SEQ ID NO: 1166 - DNA, 17 bp, Artificial sequence
  Synthesized sequence
gtggcgcgctatttccc

SEQ ID NO: 1167 - DNA, 17 bp, Artificial sequence
  Synthesized sequence
ctggcctggctttggcc

SEQ ID NO: 1168 - DNA, 17 bp, Artificial sequence
  Synthesized sequence
ctggcacccgggcggct

SEQ ID NO: 1169 - DNA, 17 bp, Artificial sequence
  Synthesized sequence
gtggccagggacttgaa

SEQ ID NO: 1170 - DNA, 17 bp, Artificial sequence
  Synthesized sequence
ctggcattcctccagct

SEQ ID NO: 1171 - DNA, 17 bp, Artificial sequence
  Synthesized sequence
gtggcgctgaccctgcc

SEQ ID NO: 1172 - DNA, 17 bp, Artificial sequence
  Synthesized sequence
tcggcacctatttcgca

SEQ ID NO: 1173 - DNA, 17 bp, Artificial sequence
  Synthesized sequence
atggcatctgccatgcc

SEQ ID NO: 1174 - DNA, 17 bp, Artificial sequence
  Synthesized sequence
ctggcgcaatgcctgcc

SEQ ID NO: 1175 - DNA, 17 bp, Artificial sequence
  Synthesized sequence
ctggcgcgcctggcgca

SEQ ID NO: 1176 - DNA, 17 bp, Artificial sequence
  Synthesized sequence
cgggcgagggcgttgct

SEQ ID NO: 1177 - DNA, 17 bp, Artificial sequence
  Synthesized sequence
ctggctccgttcctgcc

SEQ ID NO: 1178 - DNA, 17 bp, Artificial sequence
  Synthesized sequence
atgccgctgcaattgca

SEQ ID NO: 1179 - DNA, 17 bp, Artificial sequence
  Synthesized sequence
ctggggttggtcttgca

SEQ ID NO: 1180 - DNA, 17 bp, Artificial sequence
  Synthesized sequence
ctggcgcgcgacttccc

SEQ ID NO: 1181 - DNA, 17 bp, Artificial sequence
  Synthesized sequence
tcggcacgccggtggcg

SEQ ID NO: 1182 - DNA, 17 bp, Artificial sequence
  Synthesized sequence
tgggcccggctgtggct

SEQ ID NO: 1183 - DNA, 17 bp, Artificial sequence
  Synthesized sequence
ttggccgggtacttcct

SEQ ID NO: 1184 - DNA, 17 bp, Artificial sequence
  Synthesized sequence
atggcctcggccctgct

SEQ ID NO: 1185 - DNA, 17 bp, Artificial sequence
  Synthesized sequence
tcggcccaggccttgcg

SEQ ID NO: 1186 - DNA, 17 bp, Artificial sequence
  Synthesized sequence
ctggaacggccggcgct

SEQ ID NO: 1187 - DNA, 17 bp, Artificial sequence
  Synthesized sequence
cttgcccagcagttgcg

SEQ ID NO: 1188 - DNA, 17 bp, Artificial sequence
  Synthesized sequence
ccggcacgcttgttccg

SEQ ID NO: 1189 - DNA, 17 bp, Artificial sequence
  Synthesized sequence
ctggcccgcctgctgaa

SEQ ID NO: 1190 - DNA, 17 bp, Artificial sequence
  Synthesized sequence
ctggcgcgaggatggcg

SEQ ID NO: 1191 - DNA, 17 bp, Artificial sequence
  Synthesized sequence
gcggcacgccggttgag

SEQ ID NO: 1192 - DNA, 17 bp, Artificial sequence
  Synthesized sequence
caggcccggcgcatgca

SEQ ID NO: 1193 - DNA, 17 bp, Artificial sequence
  Synthesized sequence
ctggcgcgcctgccgca

SEQ ID NO: 1194 - DNA, 17 bp, Artificial sequence
  Synthesized sequence
ctggccgactggttgcc

SEQ ID NO: 1195 - DNA, 17 bp, Artificial sequence
  Synthesized sequence
ctggccgactggttgcc

SEQ ID NO: 1196 - DNA, 17 bp, Artificial sequence
  Synthesized sequence
atggcgtccgcattgcc

SEQ ID NO: 1197 - DNA, 17 bp, Artificial sequence
  Synthesized sequence
ttgccaccggtaatgca

SEQ ID NO: 1198 - DNA, 17 bp, Artificial sequence
  Synthesized sequence
ctggcctacagcctgca

SEQ ID NO: 1199 - DNA, 17 bp, Artificial sequence
  Synthesized sequence
gcggcaaggccgtggct

SEQ ID NO: 1200 - DNA, 17 bp, Artificial sequence
  Synthesized sequence
ctggcggggcgatagct

SEQ ID NO: 1201 - DNA, 17 bp, Artificial sequence
  Synthesized sequence
gtggaacttggcctgca

SEQ ID NO: 1202 - DNA, 17 bp, Artificial sequence
  Synthesized sequence
gcggcaaggcgctggca

SEQ ID NO: 1203 - DNA, 17 bp, Artificial sequence
  Synthesized sequence
gcggcacgagccttggc

SEQ ID NO: 1204 - DNA, 17 bp, Artificial sequence
  Synthesized sequence
gaggcccggcaggtgct

SEQ ID NO: 1205 - DNA, 17 bp, Artificial sequence
  Synthesized sequence
gcgggacggccgctgct

SEQ ID NO: 1206 - DNA, 17 bp, Artificial sequence
  Synthesized sequence
ctggcaacttagttgtt

SEQ ID NO: 1207 - DNA, 17 bp, Artificial sequence
  Synthesized sequence
ctggcccgcgccttccc

SEQ ID NO: 1208 - DNA, 17 bp, Artificial sequence
  Synthesized sequence
attgcaagtgccttgcc

SEQ ID NO: 1209 - DNA, 17 bp, Artificial sequence
  Synthesized sequence
gtggcgcggccgcggct

SEQ ID NO: 1210 - DNA, 17 bp, Artificial sequence
  Synthesized sequence
ctggcccaggactggcg

SEQ ID NO: 1211 - DNA, 17 bp, Artificial sequence
  Synthesized sequence
aaggcgcggcagatgct

SEQ ID NO: 1212 - DNA, 17 bp, Artificial sequence
  Synthesized sequence
gcggcagttgaattgct

SEQ ID NO: 1213 - DNA, 17 bp, Artificial sequence
  Synthesized sequence
ctggccggagcggtgct

SEQ ID NO: 1214 - DNA, 17 bp, Artificial sequence
  Synthesized sequence
ctggccccttttttcct

SEQ ID NO: 1215 - DNA, 17 bp, Artificial sequence
  Synthesized sequence
ctggcgttgccgctgct

SEQ ID NO: 1216 - DNA, 17 bp, Artificial sequence
  Synthesized sequence
gtggaaaagcattcgct

SEQ ID NO: 1217 - DNA, 17 bp, Artificial sequence
  Synthesized sequence
gtggcaatgattttccg

SEQ ID NO: 1218 - DNA, 17 bp, Artificial sequence
  Synthesized sequence
atggtacgacagaggct

SEQ ID NO: 1219 - DNA, 17 bp, Artificial sequence
  Synthesized sequence
ctgggacgacccgcgct

SEQ ID NO: 1220 - DNA, 17 bp, Artificial sequence
  Synthesized sequence
tgggcacttctttggca

SEQ ID NO: 1221 - DNA, 17 bp, Artificial sequence
  Synthesized sequence
ctggcctactcgatgct

SEQ ID NO: 1222 - DNA, 17 bp, Artificial sequence
  Synthesized sequence
ttggcaactgcgtggct

SEQ ID NO: 1223 - DNA, 17 bp, Artificial sequence
  Synthesized sequence
gtggcaacgccctggcc

SEQ ID NO: 1224 - DNA, 17 bp, Artificial sequence
  Synthesized sequence
ctggtacggcacctgga

SEQ ID NO: 1225 - DNA, 17 bp, Artificial sequence
  Synthesized sequence
ctggaaggcgaactgca

SEQ ID NO: 1226 - DNA, 17 bp, Artificial sequence
  Synthesized sequence
ctcgcacaggttctgcg

SEQ ID NO: 1227 - DNA, 17 bp, Artificial sequence
  Synthesized sequence
ctggtgagtaccttgca

SEQ ID NO: 1228 - DNA, 17 bp, Artificial sequence
  Synthesized sequence
aaggcgcgctggttgcc

SEQ ID NO: 1229 - DNA, 17 bp, Artificial sequence
  Synthesized sequence
ttggcccggcgccagca

SEQ ID NO: 1230 - DNA, 17 bp, Artificial sequence
  Synthesized sequence
gcggcacaggacgtgcc

SEQ ID NO: 1231 - DNA, 17 bp, Artificial sequence
  Synthesized sequence
tcggccggcacgttgct

SEQ ID NO: 1232 - DNA, 17 bp, Artificial sequence
  Synthesized sequence
ccggccagtcgcttgct

SEQ ID NO: 1233 - DNA, 17 bp, Artificial sequence
  Synthesized sequence
gtgccacgcttggtgcc

SEQ ID NO: 1234 - DNA, 17 bp, Artificial sequence
  Synthesized sequence
gtggcgggcatgtggca

SEQ ID NO: 1235 - DNA, 17 bp, Artificial sequence
  Synthesized sequence
atggcatcgatgacgct

SEQ ID NO: 1236 - DNA, 17 bp, Artificial sequence
  Synthesized sequence
ttcgcactatcgctgct

SEQ ID NO: 1237 - DNA, 17 bp, Artificial sequence
  Synthesized sequence
ctggcaagcccctcgat

SEQ ID NO: 1238 - DNA, 17 bp, Artificial sequence
  Synthesized sequence
ctggtcgaacggttgct

SEQ ID NO: 1239 - DNA, 17 bp, Artificial sequence
  Synthesized sequence
atggccggcaagatgca

SEQ ID NO: 1240 - DNA, 17 bp, Artificial sequence
  Synthesized sequence
gtggcactgggaatgtt

SEQ ID NO: 1241 - DNA, 17 bp, Artificial sequence
  Synthesized sequence
ctggcagcagtggtgcc

SEQ ID NO: 1242 - DNA, 17 bp, Artificial sequence
  Synthesized sequence
taggcgcgtacgttgcg

SEQ ID NO: 1243 - DNA, 17 bp, Artificial sequence
  Synthesized sequence
ctggcccacggcctgcg

SEQ ID NO: 1244 - DNA, 17 bp, Artificial sequence
  Synthesized sequence
ctggcccacggcctgcg

SEQ ID NO: 1245 - DNA, 17 bp, Artificial sequence
  Synthesized sequence
ctggccggctgtgtgct

SEQ ID NO: 1246 - DNA, 17 bp, Artificial sequence
  Synthesized sequence
ctggaacggcgcgagct

SEQ ID NO: 1247 - DNA, 17 bp, Artificial sequence
  Synthesized sequence
ctggccgaggtgctgca

SEQ ID NO: 1248 - DNA, 17 bp, Artificial sequence
  Synthesized sequence
ctggcagcagatctgcg

SEQ ID NO: 1249 - DNA, 17 bp, Artificial sequence
  Synthesized sequence
ctgtcgcggcacctgct

SEQ ID NO: 1250 - DNA, 17 bp, Artificial sequence
  Synthesized sequence
ctggctcgaataccgct

SEQ ID NO: 1251 - DNA, 17 bp, Artificial sequence
  Synthesized sequence
aagggacggttggtgct

SEQ ID NO: 1252 - DNA, 17 bp, Artificial sequence
  Synthesized sequence
atggcacgcccgtcgac

SEQ ID NO: 1253 - DNA, 17 bp, Artificial sequence
  Synthesized sequence
atggtatggagaatgcg

SEQ ID NO: 1254 - DNA, 17 bp, Artificial sequence
  Synthesized sequence
ctggcgagctgggtgct

SEQ ID NO: 1255 - DNA, 17 bp, Artificial sequence
  Synthesized sequence
ctcgccggcctgttgct

SEQ ID NO: 1256 - DNA, 17 bp, Artificial sequence
  Synthesized sequence
ctcgccggcctgttgct

SEQ ID NO: 1257 - DNA, 17 bp, Artificial sequence
  Synthesized sequence
ctggcgttgccgctgct

SEQ ID NO: 1258 - DNA, 17 bp, Artificial sequence
  Synthesized sequence
ctggcgctgcgcctgcg

SEQ ID NO: 1259 - DNA, 17 bp, Artificial sequence
  Synthesized sequence
gtggcggtactcctgct

SEQ ID NO: 1260 - DNA, 17 bp, Artificial sequence
  Synthesized sequence
atggcggcgccattgcc

SEQ ID NO: 1261 - DNA, 17 bp, Artificial sequence
  Synthesized sequence
ctcgaacgcagtttgcg

SEQ ID NO: 1262 - DNA, 17 bp, Artificial sequence
  Synthesized sequence
ctggcgcgggtcgagca

SEQ ID NO: 1263 - DNA, 17 bp, Artificial sequence
  Synthesized sequence
caggcctggctgttgcc

SEQ ID NO: 1264 - DNA, 17 bp, Artificial sequence
  Synthesized sequence
ttgactctgtagttgct

SEQ ID NO: 1265 - DNA, 17 bp, Artificial sequence
  Synthesized sequence
atcgcccggcacatgct

SEQ ID NO: 1266 - DNA, 17 bp, Artificial sequence
  Synthesized sequence
tcggtacgcgggttgcc

SEQ ID NO: 1267 - DNA, 17 bp, Artificial sequence
  Synthesized sequence
gtggtgcagatgctgct

SEQ ID NO: 1268 - DNA, 17 bp, Artificial sequence
  Synthesized sequence
atggtccggcggtcgct

SEQ ID NO: 1269 - DNA, 17 bp, Artificial sequence
  Synthesized sequence
ctggcctacggcctgct

SEQ ID NO: 1270 - DNA, 17 bp, Artificial sequence
  Synthesized sequence
gcggcgcgcgctttgcc

SEQ ID NO: 1271 - DNA, 17 bp, Artificial sequence
  Synthesized sequence
gtggtattgatctggct

SEQ ID NO: 1272 - DNA, 17 bp, Artificial sequence
  Synthesized sequence
gtggcctgggccatgcg

SEQ ID NO: 1273 - DNA, 17 bp, Artificial sequence
  Synthesized sequence
gtggaccacctgctgct

SEQ ID NO: 1274 - DNA, 17 bp, Artificial sequence
  Synthesized sequence
gtggcaggaagccggca

SEQ ID NO: 1275 - DNA, 17 bp, Artificial sequence
  Synthesized sequence
ctggcgttggtgctgct

SEQ ID NO: 1276 - DNA, 17 bp, Artificial sequence
  Synthesized sequence
ctggcacgcgcgctggc

SEQ ID NO: 1277 - DNA, 17 bp, Artificial sequence
  Synthesized sequence
ttggctcggcgccggct

SEQ ID NO: 1278 - DNA, 17 bp, Artificial sequence
  Synthesized sequence
caggcgcggcgcgtgct

SEQ ID NO: 1279 - DNA, 17 bp, Artificial sequence
  Synthesized sequence
gtggcaaggcgcatgta

SEQ ID NO: 1280 - DNA, 17 bp, Artificial sequence
  Synthesized sequence
gtggcactgctcctggc

SEQ ID NO: 1281 - DNA, 17 bp, Artificial sequence
  Synthesized sequence
ctgccacaattcatgcc

SEQ ID NO: 1282 - DNA, 17 bp, Artificial sequence
  Synthesized sequence
ctggccggctggctgct

SEQ ID NO: 1283 - DNA, 17 bp, Artificial sequence
  Synthesized sequence
gtggaccgcaacgtgca

SEQ ID NO: 1284 - DNA, 17 bp, Artificial sequence
  Synthesized sequence
gtggccgaaccgctgct

SEQ ID NO: 1285 - DNA, 17 bp, Artificial sequence
  Synthesized sequence
ctggcgccgcgcctgcg

SEQ ID NO: 1286 - DNA, 17 bp, Artificial sequence
  Synthesized sequence
ctggcacatcttcggcc

SEQ ID NO: 1287 - DNA, 17 bp, Artificial sequence
  Synthesized sequence
atggcccggggattccc

SEQ ID NO: 1288 - DNA, 17 bp, Artificial sequence
  Synthesized sequence
caggcgcgacgcctgct

SEQ ID NO: 1289 - DNA, 17 bp, Artificial sequence
  Synthesized sequence
aaggaacgacccatgca

SEQ ID NO: 1290 - DNA, 17 bp, Artificial sequence
  Synthesized sequence
ctggcggtgttcctgct

SEQ ID NO: 1291 - DNA, 17 bp, Artificial sequence
  Synthesized sequence
cgcgtacggctcttgca

SEQ ID NO: 1292 - DNA, 17 bp, Artificial sequence
  Synthesized sequence
ctggcaggatcggcgct

SEQ ID NO: 1293 - DNA, 17 bp, Artificial sequence
  Synthesized sequence
ctggctggcgagctgct

SEQ ID NO: 1294 - DNA, 17 bp, Artificial sequence
  Synthesized sequence
atggcgcccgcttcgca

SEQ ID NO: 1295 - DNA, 17 bp, Artificial sequence
  Synthesized sequence
ctggccgagttctggca

SEQ ID NO: 1296 - DNA, 17 bp, Artificial sequence
  Synthesized sequence
ctggcacgggcttcggc

SEQ ID NO: 1297 - DNA, 17 bp, Artificial sequence
  Synthesized sequence
atggcaggtacattggg

SEQ ID NO: 1298 - DNA, 17 bp, Artificial sequence
  Synthesized sequence
gtggccaggaagttact

SEQ ID NO: 1299 - DNA, 17 bp, Artificial sequence
  Synthesized sequence
ctggcgcagccttttcg

SEQ ID NO: 1300 - DNA, 17 bp, Artificial sequence
  Synthesized sequence
gtggaccaggtcctgca

SEQ ID NO: 1301 - DNA, 17 bp, Artificial sequence
  Synthesized sequence
atgccaggagcgttgcc

SEQ ID NO: 1302 - DNA, 17 bp, Artificial sequence
  Synthesized sequence
gtggcaacgcgatcgcg

SEQ ID NO: 1303 - DNA, 17 bp, Artificial sequence
  Synthesized sequence
ctggcgacggcgttgcg

SEQ ID NO: 1304 - DNA, 17 bp, Artificial sequence
  Synthesized sequence
tcgtcacgcttcttgcc

SEQ ID NO: 1305 - DNA, 17 bp, Artificial sequence
  Synthesized sequence
gaggcaccggtcctgcg

SEQ ID NO: 1306 - DNA, 17 bp, Artificial sequence
  Synthesized sequence
ctggccaagcgcatgca

SEQ ID NO: 1307 - DNA, 17 bp, Artificial sequence
  Synthesized sequence
atggcagcatccatgcc

SEQ ID NO: 1308 - DNA, 17 bp, Artificial sequence
  Synthesized sequence
ctgggccgccgactgct

SEQ ID NO: 1309 - DNA, 17 bp, Artificial sequence
  Synthesized sequence
atggcatcgccattccg

SEQ ID NO: 1310 - DNA, 17 bp, Artificial sequence
  Synthesized sequence
ttggcaatcatttcgcc

SEQ ID NO: 1311 - DNA, 17 bp, Artificial sequence
  Synthesized sequence
ttggcctggatttcgcc

SEQ ID NO: 1312 - DNA, 17 bp, Artificial sequence
  Synthesized sequence
ttggcgccagtcgtgcc

SEQ ID NO: 1313 - DNA, 17 bp, Artificial sequence
  Synthesized sequence
ctggcgccaaccctgcg

SEQ ID NO: 1314 - DNA, 17 bp, Artificial sequence
  Synthesized sequence
ctggtaccaaccctgcg

SEQ ID NO: 1315 - DNA, 17 bp, Artificial sequence
  Synthesized sequence
ctggtaccaaccctgcg

SEQ ID NO: 1316 - DNA, 17 bp, Artificial sequence
  Synthesized sequence
ctggctccgggctggca

SEQ ID NO: 1317 - DNA, 17 bp, Artificial sequence
  Synthesized sequence
ctggccgagggcctgct

SEQ ID NO: 1318 - DNA, 17 bp, Artificial sequence
  Synthesized sequence
ttggcgcgttttttggc

SEQ ID NO: 1319 - DNA, 17 bp, Artificial sequence
  Synthesized sequence
ctggtacgcaacctgtt

SEQ ID NO: 1320 - DNA, 17 bp, Artificial sequence
  Synthesized sequence
atggacgacctgttgca

SEQ ID NO: 1321 - DNA, 17 bp, Artificial sequence
  Synthesized sequence
tcggcaagcttcttgaa

SEQ ID NO: 1322 - DNA, 17 bp, Artificial sequence
  Synthesized sequence
gtggctcgatggtcgcc

SEQ ID NO: 1323 - DNA, 17 bp, Artificial sequence
  Synthesized sequence
atggaaaggatcctgcc

SEQ ID NO: 1324 - DNA, 17 bp, Artificial sequence
  Synthesized sequence
gcggcagagctgctgca

SEQ ID NO: 1325 - DNA, 17 bp, Artificial sequence
  Synthesized sequence
ctggcctgtctattcca

SEQ ID NO: 1326 - DNA, 17 bp, Artificial sequence
  Synthesized sequence
atggcagcttccttgga

SEQ ID NO: 1327 - DNA, 17 bp, Artificial sequence
  Synthesized sequence
ctggcgcgcctggcgct

SEQ ID NO: 1328 - DNA, 17 bp, Artificial sequence
  Synthesized sequence
gtggccggcggcctgca

SEQ ID NO: 1329 - DNA, 17 bp, Artificial sequence
  Synthesized sequence
ttggcgcggaacatggt

SEQ ID NO: 1330 - DNA, 17 bp, Artificial sequence
  Synthesized sequence
atggcactgacgtcgaa

SEQ ID NO: 1331 - DNA, 17 bp, Artificial sequence
  Synthesized sequence
ttggctccctaattgtt

SEQ ID NO: 1332 - DNA, 17 bp, Artificial sequence
  Synthesized sequence
ccgccatgcctgttgca

SEQ ID NO: 1333 - DNA, 17 bp, Artificial sequence
  Synthesized sequence
ctggcagcgcgttggcg

SEQ ID NO: 1334 - DNA, 17 bp, Artificial sequence
  Synthesized sequence
gtggcccagctcccgca

SEQ ID NO: 1335 - DNA, 17 bp, Artificial sequence
  Synthesized sequence
atggcagcgttgtagcc

SEQ ID NO: 1336 - DNA, 17 bp, Artificial sequence
  Synthesized sequence
ctggccaaccactcgct

SEQ ID NO: 1337 - DNA, 17 bp, Artificial sequence
  Synthesized sequence
gtgacgcgctgcttgcg

SEQ ID NO: 1338 - DNA, 17 bp, Artificial sequence
  Synthesized sequence
ctggaacggctgcttct

SEQ ID NO: 1339 - DNA, 17 bp, Artificial sequence
  Synthesized sequence
ccggaaccgcccttgcg

SEQ ID NO: 1340 - DNA, 17 bp, Artificial sequence
  Synthesized sequence
cgggcatcaatcctgct

SEQ ID NO: 1341 - DNA, 17 bp, Artificial sequence
  Synthesized sequence
ttggccggcgagctgca

SEQ ID NO: 1342 - DNA, 17 bp, Artificial sequence
  Synthesized sequence
atggccggcggcctgca

SEQ ID NO: 1343 - DNA, 17 bp, Artificial sequence
  Synthesized sequence
atggcgggacgttcgct

SEQ ID NO: 1344 - DNA, 17 bp, Artificial sequence
  Synthesized sequence
ttggccggcgcctcgct

SEQ ID NO: 1345 - DNA, 17 bp, Artificial sequence
  Synthesized sequence
ctggcccagccatcgcc

SEQ ID NO: 1346 - DNA, 17 bp, Artificial sequence
  Synthesized sequence
ctggcaaaaggctggcc

SEQ ID NO: 1347 - DNA, 17 bp, Artificial sequence
  Synthesized sequence
ttggcgccctggtggct

SEQ ID NO: 1348 - DNA, 17 bp, Artificial sequence
  Synthesized sequence
ctggtgcgcgacctgct

SEQ ID NO: 1349 - DNA, 17 bp, Artificial sequence
  Synthesized sequence
gtcgcaccggcctcgct

SEQ ID NO: 1350 - DNA, 17 bp, Artificial sequence
  Synthesized sequence
ctgggagggcatttcca

SEQ ID NO: 1351 - DNA, 17 bp, Artificial sequence
  Synthesized sequence
gcggccctctggttgca

SEQ ID NO: 1352 - DNA, 17 bp, Artificial sequence
  Synthesized sequence
ctggctgagccggtgct

SEQ ID NO: 1353 - DNA, 17 bp, Artificial sequence
  Synthesized sequence
ttggccagcacttcgct

SEQ ID NO: 1354 - DNA, 17 bp, Artificial sequence
  Synthesized sequence
atggaactcccattgga

SEQ ID NO: 1355 - DNA, 17 bp, Artificial sequence
  Synthesized sequence
ttggcctgtgccttggt

SEQ ID NO: 1356 - DNA, 17 bp, Artificial sequence
  Synthesized sequence
gtgggaaagttgctgca

SEQ ID NO: 1357 - DNA, 17 bp, Artificial sequence
  Synthesized sequence
gtggccgaggacctgct

SEQ ID NO: 1358 - DNA, 17 bp, Artificial sequence
  Synthesized sequence
gcgccacgggccttgcg

SEQ ID NO: 1359 - DNA, 17 bp, Artificial sequence
  Synthesized sequence
gcggcgccgctgttgcc

SEQ ID NO: 1360 - DNA, 17 bp, Artificial sequence
  Synthesized sequence
ctgggccagcacctgca

SEQ ID NO: 1361 - DNA, 17 bp, Artificial sequence
  Synthesized sequence
gcgggagggccattgca

SEQ ID NO: 1362 - DNA, 17 bp, Artificial sequence
  Synthesized sequence
caggcccaggccttgcc

SEQ ID NO: 1363 - DNA, 17 bp, Artificial sequence
  Synthesized sequence
ctcgccgggcagttgct

SEQ ID NO: 1364 - DNA, 17 bp, Artificial sequence
  Synthesized sequence
ctggaaggctactggca

SEQ ID NO: 1365 - DNA, 17 bp, Artificial sequence
  Synthesized sequence
ctggcactcgcggcgct

SEQ ID NO: 1366 - DNA, 17 bp, Artificial sequence
  Synthesized sequence
ctcgaacggtggttgcg

SEQ ID NO: 1367 - DNA, 17 bp, Artificial sequence
  Synthesized sequence
ctggaaagcgcggtgct

SEQ ID NO: 1368 - DNA, 17 bp, Artificial sequence
  Synthesized sequence
gtcgcccggctgctgca

SEQ ID NO: 1369 - DNA, 17 bp, Artificial sequence
  Synthesized sequence
ctggcactcttgctcca

SEQ ID NO: 1370 - DNA, 17 bp, Artificial sequence
  Synthesized sequence
ctggcactcttgctcca

SEQ ID NO: 1371 - DNA, 17 bp, Artificial sequence
  Synthesized sequence
atcgcgcggatcctgct

SEQ ID NO: 1372 - DNA, 17 bp, Artificial sequence
  Synthesized sequence
gtggcccgcatcaagct

SEQ ID NO: 1373 - DNA, 17 bp, Artificial sequence
  Synthesized sequence
acggcatgacgttttct

SEQ ID NO: 1374 - DNA, 17 bp, Artificial sequence
  Synthesized sequence
ctggcgcgaggttggcc

SEQ ID NO: 1375 - DNA, 17 bp, Artificial sequence
  Synthesized sequence
gtggttggagaattgca

SEQ ID NO: 1376 - DNA, 17 bp, Artificial sequence
  Synthesized sequence
atggccagcgccatgca

SEQ ID NO: 1377 - DNA, 17 bp, Artificial sequence
  Synthesized sequence
ttggccgggatgctgcg

SEQ ID NO: 1378 - DNA, 17 bp, Artificial sequence
  Synthesized sequence
gtggtatgcgccctgcg

SEQ ID NO: 1379 - DNA, 17 bp, Artificial sequence
  Synthesized sequence
ctggagctgccgttgcc

SEQ ID NO: 1380 - DNA, 17 bp, Artificial sequence
  Synthesized sequence
ttggcaggctgagcgct

SEQ ID NO: 1381 - DNA, 17 bp, Artificial sequence
  Synthesized sequence
ttggcaggctgagcgct

SEQ ID NO: 1382 - DNA, 17 bp, Artificial sequence
  Synthesized sequence
ctggccggtggcctgca

SEQ ID NO: 1383 - DNA, 17 bp, Artificial sequence
  Synthesized sequence
ctgccctgcgcgttgct

SEQ ID NO: 1384 - DNA, 17 bp, Artificial sequence
  Synthesized sequence
ctggcaggaccagagca

SEQ ID NO: 1385 - DNA, 17 bp, Artificial sequence
  Synthesized sequence
gaggccagcgccttgca

SEQ ID NO: 1386 - DNA, 17 bp, Artificial sequence
  Synthesized sequence
ctggaagggcgcctgcg

SEQ ID NO: 1387 - DNA, 17 bp, Artificial sequence
  Synthesized sequence
ctggtaggggcatttct

SEQ ID NO: 1388 - DNA, 17 bp, Artificial sequence
  Synthesized sequence
ctggaagaggccatgca

SEQ ID NO: 1389 - DNA, 17 bp, Artificial sequence
  Synthesized sequence
ctggtctggttcgtgct

SEQ ID NO: 1390 - DNA, 17 bp, Artificial sequence
  Synthesized sequence
gcggcccagttcgtgct

SEQ ID NO: 1391 - DNA, 17 bp, Artificial sequence
  Synthesized sequence
ctggaaagccgtttcct

SEQ ID NO: 1392 - DNA, 17 bp, Artificial sequence
  Synthesized sequence
atcgccagatccttgct

SEQ ID NO: 1393 - DNA, 17 bp, Artificial sequence
  Synthesized sequence
ctggaacagaatttccg

SEQ ID NO: 1394 - DNA, 17 bp, Artificial sequence
  Synthesized sequence
gaggcgggcgagttgct

SEQ ID NO: 1395 - DNA, 17 bp, Artificial sequence
  Synthesized sequence
ctgggactgggcctgcg

SEQ ID NO: 1396 - DNA, 17 bp, Artificial sequence
  Synthesized sequence
gtggtccgcacggtgca

SEQ ID NO: 1397 - DNA, 17 bp, Artificial sequence
  Synthesized sequence
taggcctgggccttgcg

SEQ ID NO: 1398 - DNA, 17 bp, Artificial sequence
  Synthesized sequence
ctggcaggagttcttca

SEQ ID NO: 1399 - DNA, 17 bp, Artificial sequence
  Synthesized sequence
ttggcatggaggtacca

SEQ ID NO: 1400 - DNA, 17 bp, Artificial sequence
  Synthesized sequence
gtggcactcgaaatcct

SEQ ID NO: 1401 - DNA, 17 bp, Artificial sequence
  Synthesized sequence
ccggcactcttcgtgcc

SEQ ID NO: 1402 - DNA, 17 bp, Artificial sequence
  Synthesized sequence
ctggcgccgcttttccg

SEQ ID NO: 1403 - DNA, 17 bp, Artificial sequence
  Synthesized sequence
ctggcctgggcgatgcg

SEQ ID NO: 1404 - DNA, 17 bp, Artificial sequence
  Synthesized sequence
ctggcccgcttggagct

SEQ ID NO: 1405 - DNA, 17 bp, Artificial sequence
  Synthesized sequence
ctggcacaagaagcgcc

SEQ ID NO: 1406 - DNA, 17 bp, Artificial sequence
  Synthesized sequence
atgggccgcgtcttgtt

SEQ ID NO: 1407 - DNA, 17 bp, Artificial sequence
  Synthesized sequence
atggttcgctcgatgct

SEQ ID NO: 1408 - DNA, 17 bp, Artificial sequence
  Synthesized sequence
tcggcaaagcctatgca

SEQ ID NO: 1409 - DNA, 17 bp, Artificial sequence
  Synthesized sequence
ccggcacggcatccgca

SEQ ID NO: 1410 - DNA, 17 bp, Artificial sequence
  Synthesized sequence
atggaccgtgtctggct

SEQ ID NO: 1411 - DNA, 17 bp, Artificial sequence
  Synthesized sequence
tgggcacaattattgtg

SEQ ID NO: 1412 - DNA, 17 bp, Artificial sequence
  Synthesized sequence
ccggcccaggtcctgct

SEQ ID NO: 1413 - DNA, 17 bp, Artificial sequence
  Synthesized sequence
ctggtccaggccatgct

SEQ ID NO: 1414 - DNA, 17 bp, Artificial sequence
  Synthesized sequence
ggggcaccgttggtgcg

SEQ ID NO: 1415 - DNA, 17 bp, Artificial sequence
  Synthesized sequence
gaggcacgcatcctggt

SEQ ID NO: 1416 - DNA, 17 bp, Artificial sequence
  Synthesized sequence
ccggtagagcagttgca

SEQ ID NO: 1417 - DNA, 17 bp, Artificial sequence
  Synthesized sequence
ttggcccgcctggtcca

SEQ ID NO: 1418 - DNA, 17 bp, Artificial sequence
  Synthesized sequence
gtggccgaggagctgct

SEQ ID NO: 1419 - DNA, 17 bp, Artificial sequence
  Synthesized sequence
ctggaaggcatgttcca

SEQ ID NO: 1420 - DNA, 17 bp, Artificial sequence
  Synthesized sequence
ctggcaggcacaccgca

SEQ ID NO: 1421 - DNA, 17 bp, Artificial sequence
  Synthesized sequence
ctggtacgcagcgcgct

SEQ ID NO: 1422 - DNA, 17 bp, Artificial sequence
  Synthesized sequence
ttggcctcgtcctggct

SEQ ID NO: 1423 - DNA, 17 bp, Artificial sequence
  Synthesized sequence
gtggcaggcgcggcgct

SEQ ID NO: 1424 - DNA, 17 bp, Artificial sequence
  Synthesized sequence
atggagcaccgcctgct

SEQ ID NO: 1425 - DNA, 17 bp, Artificial sequence
  Synthesized sequence
ccgccactgcggttgca

SEQ ID NO: 1426 - DNA, 17 bp, Artificial sequence
  Synthesized sequence
gtggcggtgatgctgct

SEQ ID NO: 1427 - DNA, 17 bp, Artificial sequence
  Synthesized sequence
atggcacttgacgtgga

SEQ ID NO: 1428 - DNA, 17 bp, Artificial sequence
  Synthesized sequence
ctggaattccagctgct

SEQ ID NO: 1429 - DNA, 17 bp, Artificial sequence
  Synthesized sequence
ctggtacggctatgaca

SEQ ID NO: 1430 - DNA, 17 bp, Artificial sequence
  Synthesized sequence
ctggtacggctatgaca

SEQ ID NO: 1431 - DNA, 17 bp, Artificial sequence
  Synthesized sequence
ttgaaacctttgttgca

SEQ ID NO: 1432 - DNA, 17 bp, Artificial sequence
  Synthesized sequence
ctggcgcgccttcttca

SEQ ID NO: 1433 - DNA, 17 bp, Artificial sequence
  Synthesized sequence
cttgtccgagtcttgct

SEQ ID NO: 1434 - DNA, 17 bp, Artificial sequence
  Synthesized sequence
ctggcgcggttgctgga

SEQ ID NO: 1435 - DNA, 17 bp, Artificial sequence
  Synthesized sequence
ctggccgcgctgctgca

SEQ ID NO: 1436 - DNA, 17 bp, Artificial sequence
  Synthesized sequence
ctgtcatgacggtggct

SEQ ID NO: 1437 - DNA, 17 bp, Artificial sequence
  Synthesized sequence
ctggcgttccgcctgca

SEQ ID NO: 1438 - DNA, 17 bp, Artificial sequence
  Synthesized sequence
atggcttaacgattgtt

SEQ ID NO: 1439 - DNA, 17 bp, Artificial sequence
  Synthesized sequence
atggcacgcggtattcg

SEQ ID NO: 1440 - DNA, 17 bp, Artificial sequence
  Synthesized sequence
atggcacgcggtattcg

SEQ ID NO: 1441 - DNA, 17 bp, Artificial sequence
  Synthesized sequence
attgcagccgggttgca

SEQ ID NO: 1442 - DNA, 17 bp, Artificial sequence
  Synthesized sequence
ctgtcgcgaggcttgcc

SEQ ID NO: 1443 - DNA, 17 bp, Artificial sequence
  Synthesized sequence
ctgtaccgcctgttgct

SEQ ID NO: 1444 - DNA, 17 bp, Artificial sequence
  Synthesized sequence
ctggcgagcgcctggca

SEQ ID NO: 1445 - DNA, 17 bp, Artificial sequence
  Synthesized sequence
aggggagaacttttgca

SEQ ID NO: 1446 - DNA, 17 bp, Artificial sequence
  Synthesized sequence
gaggcacctgactggct

SEQ ID NO: 1447 - DNA, 17 bp, Artificial sequence
  Synthesized sequence
gcggaacagcgcctgct

SEQ ID NO: 1448 - DNA, 17 bp, Artificial sequence
  Synthesized sequence
gcggaacagcgcctgct

SEQ ID NO: 1449 - DNA, 17 bp, Artificial sequence
  Synthesized sequence
atgacagcagggttgca

SEQ ID NO: 1450 - DNA, 17 bp, Artificial sequence
  Synthesized sequence
ctggcgctgggcctgcc

SEQ ID NO: 1451 - DNA, 17 bp, Artificial sequence
  Synthesized sequence
ccggcacgcatccggca

SEQ ID NO: 1452 - DNA, 17 bp, Artificial sequence
  Synthesized sequence
ctggtccagcaggtgca

SEQ ID NO: 1453 - DNA, 17 bp, Artificial sequence
  Synthesized sequence
gtggcactgcacacgcc

SEQ ID NO: 1454 - DNA, 17 bp, Artificial sequence
  Synthesized sequence
gtgggccgcgcgctgct

SEQ ID NO: 1455 - DNA, 17 bp, Artificial sequence
  Synthesized sequence
ctggaacggggccggca

SEQ ID NO: 1456 - DNA, 17 bp, Artificial sequence
  Synthesized sequence
tcgggacggtccgtgca

SEQ ID NO: 1457 - DNA, 17 bp, Artificial sequence
  Synthesized sequence
gtggcgggccttctgcg

SEQ ID NO: 1458 - DNA, 17 bp, Artificial sequence
  Synthesized sequence
ctggtccagctgttcct

SEQ ID NO: 1459 - DNA, 17 bp, Artificial sequence
  Synthesized sequence
aaggcatgagcgtttct

SEQ ID NO: 1460 - DNA, 17 bp, Artificial sequence
  Synthesized sequence
caggcacgcatcaggct

SEQ ID NO: 1461 - DNA, 17 bp, Artificial sequence
  Synthesized sequence
caggcacgcatcaggct

SEQ ID NO: 1462 - DNA, 17 bp, Artificial sequence
  Synthesized sequence
gtgcaacgctgtttgcc

SEQ ID NO: 1463 - DNA, 17 bp, Artificial sequence
  Synthesized sequence
gcggcactgtgatggca

SEQ ID NO: 1464 - DNA, 17 bp, Artificial sequence
  Synthesized sequence
gtggcagcgagcttgtg

SEQ ID NO: 1465 - DNA, 17 bp, Artificial sequence
  Synthesized sequence
gtggctggcgaactgca

SEQ ID NO: 1466 - DNA, 17 bp, Artificial sequence
  Synthesized sequence
acagcacgatgcttgcc

SEQ ID NO: 1467 - DNA, 17 bp, Artificial sequence
  Synthesized sequence
atggccaaggcgctgct

SEQ ID NO: 1468 - DNA, 17 bp, Artificial sequence
  Synthesized sequence
ctggcagcggagtcgcg

SEQ ID NO: 1469 - DNA, 17 bp, Artificial sequence
  Synthesized sequence
ctggctcaggcttcgcg

SEQ ID NO: 1470 - DNA, 17 bp, Artificial sequence
  Synthesized sequence
ctgtcgcgggtgctgct

SEQ ID NO: 1471 - DNA, 17 bp, Artificial sequence
  Synthesized sequence
ctgccgctggcgttgct

SEQ ID NO: 1472 - DNA, 17 bp, Artificial sequence
  Synthesized sequence
ctggaccgcttcttcct

SEQ ID NO: 1473 - DNA, 17 bp, Artificial sequence
  Synthesized sequence
caggtacgcgacatgct

SEQ ID NO: 1474 - DNA, 17 bp, Artificial sequence
  Synthesized sequence
tcgccatggacgttgca

SEQ ID NO: 1475 - DNA, 17 bp, Artificial sequence
  Synthesized sequence
ttggcctgcaccatgcc

SEQ ID NO: 1476 - DNA, 17 bp, Artificial sequence
  Synthesized sequence
atggaaatactcctgca

SEQ ID NO: 1477 - DNA, 17 bp, Artificial sequence
  Synthesized sequence
gtggcatccgcctttcc

SEQ ID NO: 1478 - DNA, 17 bp, Artificial sequence
  Synthesized sequence
atggccgacaacctgca

SEQ ID NO: 1479 - DNA, 17 bp, Artificial sequence
  Synthesized sequence
ctggcacgtcgaatggg

SEQ ID NO: 1480 - DNA, 17 bp, Artificial sequence
  Synthesized sequence
gcggcgcaccctttgcc

SEQ ID NO: 1481 - DNA, 17 bp, Artificial sequence
  Synthesized sequence
ccggcatgcgtattcca

SEQ ID NO: 1482 - DNA, 17 bp, Artificial sequence
  Synthesized sequence
ctggccgaggaggtgct

SEQ ID NO: 1483 - DNA, 17 bp, Artificial sequence
  Synthesized sequence
gtggcgctgtccatgcg

SEQ ID NO: 1484 - DNA, 17 bp, Artificial sequence
  Synthesized sequence
ctggccatgctctggca

SEQ ID NO: 1485 - DNA, 17 bp, Artificial sequence
  Synthesized sequence
gcggcacgcgcttcgcc

SEQ ID NO: 1486 - DNA, 17 bp, Artificial sequence
  Synthesized sequence
ccgccaccggctttgct

SEQ ID NO: 1487 - DNA, 17 bp, Artificial sequence
  Synthesized sequence
atgggccaggccctgct

SEQ ID NO: 1488 - DNA, 17 bp, Artificial sequence
  Synthesized sequence
atcgccagcgccttgct

SEQ ID NO: 1489 - DNA, 17 bp, Artificial sequence
  Synthesized sequence
tcggcagtgctcatgct

SEQ ID NO: 1490 - DNA, 17 bp, Artificial sequence
  Synthesized sequence
ctggaacagatcctggt

SEQ ID NO: 1491 - DNA, 17 bp, Artificial sequence
  Synthesized sequence
ttgggcaatatattgct

SEQ ID NO: 1492 - DNA, 17 bp, Artificial sequence
  Synthesized sequence
atggcatggaagccgcc

SEQ ID NO: 1493 - DNA, 17 bp, Artificial sequence
  Synthesized sequence
ctggtccgcatgttact

SEQ ID NO: 1494 - DNA, 17 bp, Artificial sequence
  Synthesized sequence
atggtcgggtccttgcg

SEQ ID NO: 1495 - DNA, 17 bp, Artificial sequence
  Synthesized sequence
gcggcagcgggcttgcg

SEQ ID NO: 1496 - DNA, 17 bp, Artificial sequence
  Synthesized sequence
atggcccgcggcccgct

SEQ ID NO: 1497 - DNA, 17 bp, Artificial sequence
  Synthesized sequence
ctgggatagcctttcca

SEQ ID NO: 1498 - DNA, 17 bp, Artificial sequence
  Synthesized sequence
ctggagcggctgttcca

SEQ ID NO: 1499 - DNA, 17 bp, Artificial sequence
  Synthesized sequence
atggaaggcgtgttcct

SEQ ID NO: 1500 - DNA, 17 bp, Artificial sequence
  Synthesized sequence
ctggtgcgccgggtgca

SEQ ID NO: 1501 - DNA, 17 bp, Artificial sequence
  Synthesized sequence
ctggcaggggctgcgca

SEQ ID NO: 1502 - DNA, 17 bp, Artificial sequence
  Synthesized sequence
atggccgagaagctgca

SEQ ID NO: 1503 - DNA, 17 bp, Artificial sequence
  Synthesized sequence
gttgcacagccagtgcg

SEQ ID NO: 1504 - DNA, 17 bp, Artificial sequence
  Synthesized sequence
ctggcacagccttcgtc

SEQ ID NO: 1505 - DNA, 17 bp, Artificial sequence
  Synthesized sequence
ctggcccgcagcctgtt

SEQ ID NO: 1506 - DNA, 17 bp, Artificial sequence
  Synthesized sequence
gtcgaacggcaggtgct

SEQ ID NO: 1507 - DNA, 17 bp, Artificial sequence
  Synthesized sequence
ctggcatagccatcgat

SEQ ID NO: 1508 - DNA, 17 bp, Artificial sequence
  Synthesized sequence
ctggtgcggcgattgtt

SEQ ID NO: 1509 - DNA, 17 bp, Artificial sequence
  Synthesized sequence
ccggccaacctgttgca

SEQ ID NO: 1510 - DNA, 17 bp, Artificial sequence
  Synthesized sequence
ctggcgccgtcctcgcg

SEQ ID NO: 1511 - DNA, 17 bp, Artificial sequence
  Synthesized sequence
gtggaacagcaatttcc

SEQ ID NO: 1512 - DNA, 17 bp, Artificial sequence
  Synthesized sequence
ccggcacttcgctggct

SEQ ID NO: 1513 - DNA, 17 bp, Artificial sequence
  Synthesized sequence
ccggcatcggtgatgct

SEQ ID NO: 1514 - DNA, 17 bp, Artificial sequence
  Synthesized sequence
ttcgcccggcgcctgct

SEQ ID NO: 1515 - DNA, 17 bp, Artificial sequence
  Synthesized sequence
gggggccgcccgttgct

SEQ ID NO: 1516 - DNA, 17 bp, Artificial sequence
  Synthesized sequence
agggcgaggctcttgcc

SEQ ID NO: 1517 - DNA, 17 bp, Artificial sequence
  Synthesized sequence
ctggcactggtcgagcg

SEQ ID NO: 1518 - DNA, 17 bp, Artificial sequence
  Synthesized sequence
gtgggcaaggagttgct

SEQ ID NO: 1519 - DNA, 17 bp, Artificial sequence
  Synthesized sequence
ggggcagaagtgatgct

SEQ ID NO: 1520 - DNA, 17 bp, Artificial sequence
  Synthesized sequence
atggcagggctcctggg

SEQ ID NO: 1521 - DNA, 17 bp, Artificial sequence
  Synthesized sequence
cgggcaaggtagtggca

SEQ ID NO: 1522 - DNA, 17 bp, Artificial sequence
  Synthesized sequence
atcgaacgggacctgct

SEQ ID NO: 1523 - DNA, 17 bp, Artificial sequence
  Synthesized sequence
atcgaacgggacctgct

SEQ ID NO: 1524 - DNA, 17 bp, Artificial sequence
  Synthesized sequence
ctggtgcggatcgtgcc

SEQ ID NO: 1525 - DNA, 17 bp, Artificial sequence
  Synthesized sequence
caggcccgggaactgct

SEQ ID NO: 1526 - DNA, 17 bp, Artificial sequence
  Synthesized sequence
aaggcacatgcctttca

SEQ ID NO: 1527 - DNA, 17 bp, Artificial sequence
  Synthesized sequence
ctggtgccgggcttgcg

SEQ ID NO: 1528 - DNA, 17 bp, Artificial sequence
  Synthesized sequence
gtggcaagccgaatgaa

SEQ ID NO: 1529 - DNA, 17 bp, Artificial sequence
  Synthesized sequence
ctggaacgccagcggca

SEQ ID NO: 1530 - DNA, 17 bp, Artificial sequence
  Synthesized sequence
cagggccgccaattgct

SEQ ID NO: 1531 - DNA, 17 bp, Artificial sequence
  Synthesized sequence
ctggcactgaaattcgt

SEQ ID NO: 1532 - DNA, 17 bp, Artificial sequence
  Synthesized sequence
gaggcgcgggcgatgct

SEQ ID NO: 1533 - DNA, 17 bp, Artificial sequence
  Synthesized sequence
ctggcaacctctctgcc

SEQ ID NO: 1534 - DNA, 17 bp, Artificial sequence
  Synthesized sequence
ctggctcggcgacggct

SEQ ID NO: 1535 - DNA, 17 bp, Artificial sequence
  Synthesized sequence
ctggcctggccgtcgcg

SEQ ID NO: 1536 - DNA, 17 bp, Artificial sequence
  Synthesized sequence
ctggcgcgctacaagct

SEQ ID NO: 1537 - DNA, 17 bp, Artificial sequence
  Synthesized sequence
ctgggacgggtgctgaa

SEQ ID NO: 1538 - DNA, 17 bp, Artificial sequence
  Synthesized sequence
ttcgaacggatttcgct

SEQ ID NO: 1539 - DNA, 17 bp, Artificial sequence
  Synthesized sequence
ttcgaacggatttcgct

SEQ ID NO: 1540 - DNA, 17 bp, Artificial sequence
  Synthesized sequence
ctggagcgcacggtgca

SEQ ID NO: 1541 - DNA, 17 bp, Artificial sequence
  Synthesized sequence
ttggcttcgttcttgat

SEQ ID NO: 1542 - DNA, 17 bp, Artificial sequence
  Synthesized sequence
ttcgcccgcctgctgct

SEQ ID NO: 1543 - DNA, 17 bp, Artificial sequence
  Synthesized sequence
gtggtcaagtcgttgca

SEQ ID NO: 1544 - DNA, 17 bp, Artificial sequence
  Synthesized sequence
agggcccgttcgttgcc

SEQ ID NO: 1545 - DNA, 17 bp, Artificial sequence
  Synthesized sequence
aaggtgcgccggttgct

SEQ ID NO: 1546 - DNA, 17 bp, Artificial sequence
  Synthesized sequence
ctggttcggcggttggt

SEQ ID NO: 1547 - DNA, 17 bp, Artificial sequence
  Synthesized sequence
ctggaatcgatcttcct

SEQ ID NO: 1548 - DNA, 17 bp, Artificial sequence
  Synthesized sequence
ctggcgcgccaccggca

SEQ ID NO: 1549 - DNA, 17 bp, Artificial sequence
  Synthesized sequence
ctggctcggccgacgca

SEQ ID NO: 1550 - DNA, 17 bp, Artificial sequence
  Synthesized sequence
ccggaacaggcgttgcc

SEQ ID NO: 1551 - DNA, 17 bp, Artificial sequence
  Synthesized sequence
gcggcgcagctgatgct

SEQ ID NO: 1552 - DNA, 17 bp, Artificial sequence
  Synthesized sequence
gtggtagcggtggtgct

SEQ ID NO: 1553 - DNA, 17 bp, Artificial sequence
  Synthesized sequence
ttggccggacaattaca

SEQ ID NO: 1554 - DNA, 17 bp, Artificial sequence
  Synthesized sequence
agggcaggcgcgctgct

SEQ ID NO: 1555 - DNA, 17 bp, Artificial sequence
  Synthesized sequence
atggcccgccacatcct

SEQ ID NO: 1556 - DNA, 17 bp, Artificial sequence
  Synthesized sequence
gtggcgctgggcatgcg

SEQ ID NO: 1557 - DNA, 17 bp, Artificial sequence
  Synthesized sequence
atggcgcgggtggtgat

SEQ ID NO: 1558 - DNA, 17 bp, Artificial sequence
  Synthesized sequence
ctggcccgccaccagca

SEQ ID NO: 1559 - DNA, 17 bp, Artificial sequence
  Synthesized sequence
ctggcaggcgatgggct

SEQ ID NO: 1560 - DNA, 17 bp, Artificial sequence
  Synthesized sequence
tcggcatggaagctgcc

SEQ ID NO: 1561 - DNA, 17 bp, Artificial sequence
  Synthesized sequence
gtggccggcggttcgct

SEQ ID NO: 1562 - DNA, 17 bp, Artificial sequence
  Synthesized sequence
ctggaccaggtgctgct

SEQ ID NO: 1563 - DNA, 17 bp, Artificial sequence
  Synthesized sequence
ctggagcgcgcgctgct

SEQ ID NO: 1564 - DNA, 17 bp, Artificial sequence
  Synthesized sequence
gtggagcgatcggtgca

SEQ ID NO: 1565 - DNA, 17 bp, Artificial sequence
  Synthesized sequence
ttggcgagctgctggca

SEQ ID NO: 1566 - DNA, 17 bp, Artificial sequence
  Synthesized sequence
ctggcgcggcgcaagca

SEQ ID NO: 1567 - DNA, 17 bp, Artificial sequence
  Synthesized sequence
caggcgcggcgctggct

SEQ ID NO: 1568 - DNA, 17 bp, Artificial sequence
  Synthesized sequence
tgggcgaagtccttgct

SEQ ID NO: 1569 - DNA, 17 bp, Artificial sequence
  Synthesized sequence
caggaacggcttttcca

SEQ ID NO: 1570 - DNA, 17 bp, Artificial sequence
  Synthesized sequence
ctgggacgccaccggca

SEQ ID NO: 1571 - DNA, 17 bp, Artificial sequence
  Synthesized sequence
taggcacggaagccgct

SEQ ID NO: 1572 - DNA, 17 bp, Artificial sequence
  Synthesized sequence
ctggcgcagctcctgaa

SEQ ID NO: 1573 - DNA, 17 bp, Artificial sequence
  Synthesized sequence
gcggcacgccagccgct

SEQ ID NO: 1574 - DNA, 17 bp, Artificial sequence
  Synthesized sequence
ccggcgctcatcttgcg

SEQ ID NO: 1575 - DNA, 17 bp, Artificial sequence
  Synthesized sequence
ctggcaggagcggcgca

SEQ ID NO: 1576 - DNA, 17 bp, Artificial sequence
  Synthesized sequence
gtgcaactggagttgca

SEQ ID NO: 1577 - DNA, 17 bp, Artificial sequence
  Synthesized sequence
ctggcccgcagcgagct

SEQ ID NO: 1578 - DNA, 17 bp, Artificial sequence
  Synthesized sequence
gaggcgcggatgttcct

SEQ ID NO: 1579 - DNA, 17 bp, Artificial sequence
  Synthesized sequence
ttggcgaaccactggct

SEQ ID NO: 1580 - DNA, 17 bp, Artificial sequence
  Synthesized sequence
ttggaacggtcgaagct

SEQ ID NO: 1581 - DNA, 17 bp, Artificial sequence
  Synthesized sequence
acggcactgtccttcca

SEQ ID NO: 1582 - DNA, 17 bp, Artificial sequence
  Synthesized sequence
cttccacgtaaattgca

SEQ ID NO: 1583 - DNA, 17 bp, Artificial sequence
  Synthesized sequence
cgggaacggttgtcgca

SEQ ID NO: 1584 - DNA, 17 bp, Artificial sequence
  Synthesized sequence
gtggcgccgtcggtgcg

SEQ ID NO: 1585 - DNA, 17 bp, Artificial sequence
  Synthesized sequence
cttgcacgcggcctgcc

SEQ ID NO: 1586 - DNA, 17 bp, Artificial sequence
  Synthesized sequence
ccggcgccgcgcttgcg

SEQ ID NO: 1587 - DNA, 17 bp, Artificial sequence
  Synthesized sequence
caggaaaaacctttgct

SEQ ID NO: 1588 - DNA, 17 bp, Artificial sequence
  Synthesized sequence
ccggcacaagtgttgtg

SEQ ID NO: 1589 - DNA, 17 bp, Artificial sequence
  Synthesized sequence
ggggcataatcctggct

SEQ ID NO: 1590 - DNA, 17 bp, Artificial sequence
  Synthesized sequence
ctggcctggagctggcg

SEQ ID NO: 1591 - DNA, 17 bp, Artificial sequence
  Synthesized sequence
atgaaaccttccttgct

SEQ ID NO: 1592 - DNA, 17 bp, Artificial sequence
  Synthesized sequence
caggcccgcgacctgca

SEQ ID NO: 1593 - DNA, 17 bp, Artificial sequence
  Synthesized sequence
tcggcgacgttcttgct

SEQ ID NO: 1594 - DNA, 17 bp, Artificial sequence
  Synthesized sequence
caggcatggctatggcg

SEQ ID NO: 1595 - DNA, 17 bp, Artificial sequence
  Synthesized sequence
gcggcgcgggatgtgct

SEQ ID NO: 1596 - DNA, 17 bp, Artificial sequence
  Synthesized sequence
ttcgtgcgcctgttgct

SEQ ID NO: 1597 - DNA, 17 bp, Artificial sequence
  Synthesized sequence
gtggccgacgccctgct

SEQ ID NO: 1598 - DNA, 17 bp, Artificial sequence
  Synthesized sequence
tgcgcacggctggtgct

SEQ ID NO: 1599 - DNA, 17 bp, Artificial sequence
  Synthesized sequence
ctggatcaagaattgcc

SEQ ID NO: 1600 - DNA, 17 bp, Artificial sequence
  Synthesized sequence
ctggcacaatgcacgcc

SEQ ID NO: 1601 - DNA, 17 bp, Artificial sequence
  Synthesized sequence
ctggaacggcaactgga

SEQ ID NO: 1602 - DNA, 17 bp, Artificial sequence
  Synthesized sequence
caggcccgccgctcgct

SEQ ID NO: 1603 - DNA, 17 bp, Artificial sequence
  Synthesized sequence
atggccccgctcccgct

SEQ ID NO: 1604 - DNA, 17 bp, Artificial sequence
  Synthesized sequence
ttggcccgccccacgca

SEQ ID NO: 1605 - DNA, 17 bp, Artificial sequence
  Synthesized sequence
atggctggacggttact

SEQ ID NO: 1606 - DNA, 17 bp, Artificial sequence
  Synthesized sequence
gtggaccgaggtctgca

SEQ ID NO: 1607 - DNA, 17 bp, Artificial sequence
  Synthesized sequence
ttggcccgcgtgctgtt

SEQ ID NO: 1608 - DNA, 17 bp, Artificial sequence
  Synthesized sequence
ctcgcgccttacttgct

SEQ ID NO: 1609 - DNA, 17 bp, Artificial sequence
  Synthesized sequence
tcgccgcggatcttgct

SEQ ID NO: 1610 - DNA, 17 bp, Artificial sequence
  Synthesized sequence
ttcgcgcagcgcttgcc

SEQ ID NO: 1611 - DNA, 17 bp, Artificial sequence
  Synthesized sequence
acggaaggtttgttgca

SEQ ID NO: 1612 - DNA, 17 bp, Artificial sequence
  Synthesized sequence
ttggcgtagcacctgcg

SEQ ID NO: 1613 - DNA, 17 bp, Artificial sequence
  Synthesized sequence
ctggcacggctggcgaa

SEQ ID NO: 1614 - DNA, 17 bp, Artificial sequence
  Synthesized sequence
atcgtgcggaacttgct

SEQ ID NO: 1615 - DNA, 17 bp, Artificial sequence
  Synthesized sequence
ttggcgatgcccatgct

SEQ ID NO: 1616 - DNA, 17 bp, Artificial sequence
  Synthesized sequence
atggaaggggctttcct

SEQ ID NO: 1617 - DNA, 17 bp, Artificial sequence
  Synthesized sequence
gtggcatgcgatctcca

SEQ ID NO: 1618 - DNA, 17 bp, Artificial sequence
  Synthesized sequence
ctggaatgcgacgtgcg

SEQ ID NO: 1619 - DNA, 17 bp, Artificial sequence
  Synthesized sequence
gaggaacgagccctgct

SEQ ID NO: 1620 - DNA, 17 bp, Artificial sequence
  Synthesized sequence
ctggcaggtacccggca

SEQ ID NO: 1621 - DNA, 17 bp, Artificial sequence
  Synthesized sequence
cagccccggctcttgca

SEQ ID NO: 1622 - DNA, 17 bp, Artificial sequence
  Synthesized sequence
ctggcagaccgattccg

SEQ ID NO: 1623 - DNA, 17 bp, Artificial sequence
  Synthesized sequence
ctcgaactcgatttgct

SEQ ID NO: 1624 - DNA, 17 bp, Artificial sequence
  Synthesized sequence
ttgccaccggcctggca

SEQ ID NO: 1625 - DNA, 17 bp, Artificial sequence
  Synthesized sequence
caggccttgcagttgct

SEQ ID NO: 1626 - DNA, 17 bp, Artificial sequence
  Synthesized sequence
cgggcaagaaaatcgct

SEQ ID NO: 1627 - DNA, 17 bp, Artificial sequence
  Synthesized sequence
gtgcaatggctgttgcg

SEQ ID NO: 1628 - DNA, 17 bp, Artificial sequence
  Synthesized sequence
ctgacccgcgcgttgcg

SEQ ID NO: 1629 - DNA, 17 bp, Artificial sequence
  Synthesized sequence
gtggcgttgcaggtgca

SEQ ID NO: 1630 - DNA, 17 bp, Artificial sequence
  Synthesized sequence
cgggcgcggccctggca

SEQ ID NO: 1631 - DNA, 17 bp, Artificial sequence
  Synthesized sequence
ctggctcggcgtcggct

SEQ ID NO: 1632 - DNA, 17 bp, Artificial sequence
  Synthesized sequence
agggcaggccggtggct

SEQ ID NO: 1633 - DNA, 17 bp, Artificial sequence
  Synthesized sequence
ctggccgagcgcttcct

SEQ ID NO: 1634 - DNA, 17 bp, Artificial sequence
  Synthesized sequence
gacgcatgggagttgca

SEQ ID NO: 1635 - DNA, 17 bp, Artificial sequence
  Synthesized sequence
gcggcagggagatggct

SEQ ID NO: 1636 - DNA, 17 bp, Artificial sequence
  Synthesized sequence
cgggcaaggtcctggca

SEQ ID NO: 1637 - DNA, 17 bp, Artificial sequence
  Synthesized sequence
cgggcacatggatcgca

SEQ ID NO: 1638 - DNA, 17 bp, Artificial sequence
  Synthesized sequence
ttggcgctgagcatgcc

SEQ ID NO: 1639 - DNA, 17 bp, Artificial sequence
  Synthesized sequence
ctggcccggcatatcct

SEQ ID NO: 1640 - DNA, 17 bp, Artificial sequence
  Synthesized sequence
agggtacgggtatcgct

SEQ ID NO: 1641 - DNA, 17 bp, Artificial sequence
  Synthesized sequence
ccggaatgccccttgcg

SEQ ID NO: 1642 - DNA, 17 bp, Artificial sequence
  Synthesized sequence
tttgcagtggtcttgcg

SEQ ID NO: 1643 - DNA, 17 bp, Artificial sequence
  Synthesized sequence
ctgtcgtggatcttgcc

SEQ ID NO: 1644 - DNA, 17 bp, Artificial sequence
  Synthesized sequence
ctggcagagcatcggca

SEQ ID NO: 1645 - DNA, 17 bp, Artificial sequence
  Synthesized sequence
ctggcagagcatcggca

SEQ ID NO: 1646 - DNA, 17 bp, Artificial sequence
  Synthesized sequence
ctggtattcgccctgct

SEQ ID NO: 1647 - DNA, 17 bp, Artificial sequence
  Synthesized sequence
ctggaactgaagctgcc

SEQ ID NO: 1648 - DNA, 17 bp, Artificial sequence
  Synthesized sequence
gtggctcgcgtcgcgca

SEQ ID NO: 1649 - DNA, 17 bp, Artificial sequence
  Synthesized sequence
gcggccggtccgttgct

SEQ ID NO: 1650 - DNA, 17 bp, Artificial sequence
  Synthesized sequence
ctggcccgggccgggca

SEQ ID NO: 1651 - DNA, 17 bp, Artificial sequence
  Synthesized sequence
ctggcgccggccatgcg

SEQ ID NO: 1652 - DNA, 17 bp, Artificial sequence
  Synthesized sequence
ctggtaagggtggtgcc

SEQ ID NO: 1653 - DNA, 17 bp, Artificial sequence
  Synthesized sequence
gtgccacgcctatttcg

SEQ ID NO: 1654 - DNA, 17 bp, Artificial sequence
  Synthesized sequence
ctggcaggggaggtggt

SEQ ID NO: 1655 - DNA, 17 bp, Artificial sequence
  Synthesized sequence
atggcaaggtgctgggt

SEQ ID NO: 1656 - DNA, 17 bp, Artificial sequence
  Synthesized sequence
atggcgcgagccgggct

SEQ ID NO: 1657 - DNA, 17 bp, Artificial sequence
  Synthesized sequence
cgggttcgccagttgct

SEQ ID NO: 1658 - DNA, 17 bp, Artificial sequence
  Synthesized sequence
aaggcccgccggctgct

SEQ ID NO: 1659 - DNA, 17 bp, Artificial sequence
  Synthesized sequence
ctggaaatgatctggct

SEQ ID NO: 1660 - DNA, 17 bp, Artificial sequence
  Synthesized sequence
gttgcacctgtggtgct

SEQ ID NO: 1661 - DNA, 17 bp, Artificial sequence
  Synthesized sequence
ctggcctggacctggcg

SEQ ID NO: 1662 - DNA, 17 bp, Artificial sequence
  Synthesized sequence
ctggcgcaactggcgct

SEQ ID NO: 1663 - DNA, 17 bp, Artificial sequence
  Synthesized sequence
ctgtcacagtcgtttca

SEQ ID NO: 1664 - DNA, 17 bp, Artificial sequence
  Synthesized sequence
aaggaacacctgctgct

SEQ ID NO: 1665 - DNA, 17 bp, Artificial sequence
  Synthesized sequence
ctggcatcgccgcggct

SEQ ID NO: 1666 - DNA, 17 bp, Artificial sequence
  Synthesized sequence
gtcgaacggttgctgct

SEQ ID NO: 1667 - DNA, 17 bp, Artificial sequence
  Synthesized sequence
ttgcgaggctttttgct

SEQ ID NO: 1668 - DNA, 17 bp, Artificial sequence
  Synthesized sequence
gcggcgcagatagtgct

SEQ ID NO: 1669 - DNA, 17 bp, Artificial sequence
  Synthesized sequence
ctgggtcaggtcctgct

SEQ ID NO: 1670 - DNA, 17 bp, Artificial sequence
  Synthesized sequence
cgggcaccgccgatgcg

SEQ ID NO: 1671 - DNA, 17 bp, Artificial sequence
  Synthesized sequence
atggattgcgtgttgcg

SEQ ID NO: 1672 - DNA, 17 bp, Artificial sequence
  Synthesized sequence
atggcgctccccgtgcc

SEQ ID NO: 1673 - DNA, 17 bp, Artificial sequence
  Synthesized sequence
atgccgctggcgttgct

SEQ ID NO: 1674 - DNA, 17 bp, Artificial sequence
  Synthesized sequence
cgggcgcgaccactgct

SEQ ID NO: 1675 - DNA, 17 bp, Artificial sequence
  Synthesized sequence
ctgggccaacaactgct

SEQ ID NO: 1676 - DNA, 17 bp, Artificial sequence
  Synthesized sequence
ccggaacgcctctggca

SEQ ID NO: 1677 - DNA, 17 bp, Artificial sequence
  Synthesized sequence
cgggcgcgcagcctgct

SEQ ID NO: 1678 - DNA, 17 bp, Artificial sequence
  Synthesized sequence
ctgtcacaacgcctgcg

SEQ ID NO: 1679 - DNA, 17 bp, Artificial sequence
  Synthesized sequence
ctggaaatcttcctgct

SEQ ID NO: 1680 - DNA, 17 bp, Artificial sequence
  Synthesized sequence
atagcgccaggattgct

SEQ ID NO: 1681 - DNA, 17 bp, Artificial sequence
  Synthesized sequence
atggaaagcctgatgcg

SEQ ID NO: 1682 - DNA, 17 bp, Artificial sequence
  Synthesized sequence
gcggccagcgagttgca

SEQ ID NO: 1683 - DNA, 17 bp, Artificial sequence
  Synthesized sequence
ctggtccgcgaactgca

SEQ ID NO: 1684 - DNA, 17 bp, Artificial sequence
  Synthesized sequence
tgggtacgcgaactgct

SEQ ID NO: 1685 - DNA, 17 bp, Artificial sequence
  Synthesized sequence
gtggtccgcgccgtgca

SEQ ID NO: 1686 - DNA, 17 bp, Artificial sequence
  Synthesized sequence
ttggaccggcgtttgta

SEQ ID NO: 1687 - DNA, 17 bp, Artificial sequence
  Synthesized sequence
ctggcgcggaacaagca

SEQ ID NO: 1688 - DNA, 17 bp, Artificial sequence
  Synthesized sequence
ttcgcaggcctttagct

SEQ ID NO: 1689 - DNA, 17 bp, Artificial sequence
  Synthesized sequence
ttgggacagacatggcc

SEQ ID NO: 1690 - DNA, 17 bp, Artificial sequence
  Synthesized sequence
ctggcgcgcaacctgtt

SEQ ID NO: 1691 - DNA, 17 bp, Artificial sequence
  Synthesized sequence
ctggcgccgaactcgcg

SEQ ID NO: 1692 - DNA, 17 bp, Artificial sequence
  Synthesized sequence
aaggctcggacctggct

SEQ ID NO: 1693 - DNA, 17 bp, Artificial sequence
  Synthesized sequence
gcggcattcctgctgct

SEQ ID NO: 1694 - DNA, 17 bp, Artificial sequence
  Synthesized sequence
ctggagcgcttcttcct

SEQ ID NO: 1695 - DNA, 17 bp, Artificial sequence
  Synthesized sequence
gtggccggcaagttcct

SEQ ID NO: 1696 - DNA, 17 bp, Artificial sequence
  Synthesized sequence
atggcttccatgctgct

SEQ ID NO: 1697 - DNA, 17 bp, Artificial sequence
  Synthesized sequence
ctggcaaaatccgcgct

SEQ ID NO: 1698 - DNA, 17 bp, Artificial sequence
  Synthesized sequence
ttggcatgaagatcggt

SEQ ID NO: 1699 - DNA, 17 bp, Artificial sequence
  Synthesized sequence
ctggaacgccctgcgct

SEQ ID NO: 1700 - DNA, 17 bp, Artificial sequence
  Synthesized sequence
gtggcgtgagtggtgcc

SEQ ID NO: 1701 - DNA, 17 bp, Artificial sequence
  Synthesized sequence
atggcgaaggcactgct

SEQ ID NO: 1702 - DNA, 17 bp, Artificial sequence
  Synthesized sequence
atggcgaaggcactgct

SEQ ID NO: 1703 - DNA, 17 bp, Artificial sequence
  Synthesized sequence
ctggcaattgccctgcg

SEQ ID NO: 1704 - DNA, 17 bp, Artificial sequence
  Synthesized sequence
tcggcccggcgctggca

SEQ ID NO: 1705 - DNA, 17 bp, Artificial sequence
  Synthesized sequence
ctggccgccctctcgct

SEQ ID NO: 1706 - DNA, 17 bp, Artificial sequence
  Synthesized sequence
ctggtccgtcgcatgca

SEQ ID NO: 1707 - DNA, 17 bp, Artificial sequence
  Synthesized sequence
gtggttcgccattcgca

SEQ ID NO: 1708 - DNA, 17 bp, Artificial sequence
  Synthesized sequence
cgggcccgcgacctgct

SEQ ID NO: 1709 - DNA, 17 bp, Artificial sequence
  Synthesized sequence
gtggcaccgcaggcgcc

SEQ ID NO: 1710 - DNA, 17 bp, Artificial sequence
  Synthesized sequence
gtgtcgcatggcttgca

SEQ ID NO: 1711 - DNA, 17 bp, Artificial sequence
  Synthesized sequence
ccggcgcgccgcatgct

SEQ ID NO: 1712 - DNA, 17 bp, Artificial sequence
  Synthesized sequence
gcggcgcgcgccctgct

SEQ ID NO: 1713 - DNA, 17 bp, Artificial sequence
  Synthesized sequence
ttggcatacatctcgaa

SEQ ID NO: 1714 - DNA, 17 bp, Artificial sequence
  Synthesized sequence
ctgggactgggcgtgcg

SEQ ID NO: 1715 - DNA, 17 bp, Artificial sequence
  Synthesized sequence
ctggagcgcctgtggca

SEQ ID NO: 1716 - DNA, 17 bp, Artificial sequence
  Synthesized sequence
gcggccggctcgttgct

SEQ ID NO: 1717 - DNA, 17 bp, Artificial sequence
  Synthesized sequence
ttggccctggacatgcc

SEQ ID NO: 1718 - DNA, 17 bp, Artificial sequence
  Synthesized sequence
ctggccctggtggtgcc

SEQ ID NO: 1719 - DNA, 17 bp, Artificial sequence
  Synthesized sequence
tgggcgcggccggtgca

SEQ ID NO: 1720 - DNA, 17 bp, Artificial sequence
  Synthesized sequence
atggcccggcgcatcca

SEQ ID NO: 1721 - DNA, 17 bp, Artificial sequence
  Synthesized sequence
ctgggacgccatcggca

SEQ ID NO: 1722 - DNA, 17 bp, Artificial sequence
  Synthesized sequence
gtggcgttctccctgct

SEQ ID NO: 1723 - DNA, 17 bp, Artificial sequence
  Synthesized sequence
gtggcaggagggccgct

SEQ ID NO: 1724 - DNA, 17 bp, Artificial sequence
  Synthesized sequence
ctgggaagcggttcgct

SEQ ID NO: 1725 - DNA, 17 bp, Artificial sequence
  Synthesized sequence
ctagcatggatattcca

SEQ ID NO: 1726 - DNA, 17 bp, Artificial sequence
  Synthesized sequence
gtgcctcgaagtttgcc

SEQ ID NO: 1727 - DNA, 17 bp, Artificial sequence
  Synthesized sequence
ttggcacgatgagtacc

SEQ ID NO: 1728 - DNA, 17 bp, Artificial sequence
  Synthesized sequence
ctggaacgccaggcgca

SEQ ID NO: 1729 - DNA, 17 bp, Artificial sequence
  Synthesized sequence
ctggcggtgatgctgct

SEQ ID NO: 1730 - DNA, 17 bp, Artificial sequence
  Synthesized sequence
ggggcaggaggaatgct

SEQ ID NO: 1731 - DNA, 17 bp, Artificial sequence
  Synthesized sequence
cttccacggcagttgcc

SEQ ID NO: 1732 - DNA, 17 bp, Artificial sequence
  Synthesized sequence
gtggtacgggccgggca

SEQ ID NO: 1733 - DNA, 17 bp, Artificial sequence
  Synthesized sequence
ctggcgcgccaccggca

SEQ ID NO: 1734 - DNA, 17 bp, Artificial sequence
  Synthesized sequence
ctggcggcgttgctgct

SEQ ID NO: 1735 - DNA, 17 bp, Artificial sequence
  Synthesized sequence
ctggcgcaatccttgtc

SEQ ID NO: 1736 - DNA, 17 bp, Artificial sequence
  Synthesized sequence
ctggaagagggcgtgct

SEQ ID NO: 1737 - DNA, 17 bp, Artificial sequence
  Synthesized sequence
ctggtacgccactggtt

SEQ ID NO: 1738 - DNA, 17 bp, Artificial sequence
  Synthesized sequence
cttgcccggcgcctgca

SEQ ID NO: 1739 - DNA, 17 bp, Artificial sequence
  Synthesized sequence
ctgtctcggtgattgcc

SEQ ID NO: 1740 - DNA, 17 bp, Artificial sequence
  Synthesized sequence
ctgtctcggtgattgcc

SEQ ID NO: 1741 - DNA, 17 bp, Artificial sequence
  Synthesized sequence
ttggtacgcgggttccg

SEQ ID NO: 1742 - DNA, 17 bp, Artificial sequence
  Synthesized sequence
ctggtgccgctgctgct

SEQ ID NO: 1743 - DNA, 17 bp, Artificial sequence
  Synthesized sequence
gcggcagcgctgctgct

SEQ ID NO: 1744 - DNA, 17 bp, Artificial sequence
  Synthesized sequence
cgggcgcgggcgctgct

SEQ ID NO: 1745 - DNA, 17 bp, Artificial sequence
  Synthesized sequence
atggcatctccttggcg

SEQ ID NO: 1746 - DNA, 17 bp, Artificial sequence
  Synthesized sequence
ccggcccagttgctgct

SEQ ID NO: 1747 - DNA, 17 bp, Artificial sequence
  Synthesized sequence
gtggcgctgcactggcc

SEQ ID NO: 1748 - DNA, 17 bp, Artificial sequence
  Synthesized sequence
atggccgcgcaactgct

SEQ ID NO: 1749 - DNA, 17 bp, Artificial sequence
  Synthesized sequence
gtggtccaccgcctgca

SEQ ID NO: 1750 - DNA, 17 bp, Artificial sequence
  Synthesized sequence
ctggcgggagacttgta

SEQ ID NO: 1751 - DNA, 17 bp, Artificial sequence
  Synthesized sequence
ttggcttcgaaactgca

SEQ ID NO: 1752 - DNA, 17 bp, Artificial sequence
  Synthesized sequence
ctgggactaccgctgcc

SEQ ID NO: 1753 - DNA, 17 bp, Artificial sequence
  Synthesized sequence
caggccaagccgttgct

SEQ ID NO: 1754 - DNA, 17 bp, Artificial sequence
  Synthesized sequence
ctggcgcggctgttcat

SEQ ID NO: 1755 - DNA, 17 bp, Artificial sequence
  Synthesized sequence
gtggaagacgtcatgca

SEQ ID NO: 1756 - DNA, 17 bp, Artificial sequence
  Synthesized sequence
atgacacgggattagcg

SEQ ID NO: 1757 - DNA, 17 bp, Artificial sequence
  Synthesized sequence
atggcaaaaatcgggca

SEQ ID NO: 1758 - DNA, 17 bp, Artificial sequence
  Synthesized sequence
ggggaatggcaattgcc

SEQ ID NO: 1759 - DNA, 17 bp, Artificial sequence
  Synthesized sequence
gaggaacggcgctggct

SEQ ID NO: 1760 - DNA, 17 bp, Artificial sequence
  Synthesized sequence
acggcatgggttctgcc

SEQ ID NO: 1761 - DNA, 17 bp, Artificial sequence
  Synthesized sequence
ctggaagtgcacctgct

SEQ ID NO: 1762 - DNA, 17 bp, Artificial sequence
  Synthesized sequence
ctgggccagcgcctgca

SEQ ID NO: 1763 - DNA, 17 bp, Artificial sequence
  Synthesized sequence
atggccgcgttgatgct

SEQ ID NO: 1764 - DNA, 17 bp, Artificial sequence
  Synthesized sequence
ttggctggcggcatgca

SEQ ID NO: 1765 - DNA, 17 bp, Artificial sequence
  Synthesized sequence
ctgggccgggcgctgca

SEQ ID NO: 1766 - DNA, 17 bp, Artificial sequence
  Synthesized sequence
gtggcgccgccctggcg

SEQ ID NO: 1767 - DNA, 17 bp, Artificial sequence
  Synthesized sequence
atggtccgccagtggca

SEQ ID NO: 1768 - DNA, 17 bp, Artificial sequence
  Synthesized sequence
ctggtgcgactcctgcg

SEQ ID NO: 1769 - DNA, 17 bp, Artificial sequence
  Synthesized sequence
ctgggacgccacgcgca

SEQ ID NO: 1770 - DNA, 17 bp, Artificial sequence
  Synthesized sequence
ccggcagaagacctgct

SEQ ID NO: 1771 - DNA, 17 bp, Artificial sequence
  Synthesized sequence
ggggcatatcgtctgct

SEQ ID NO: 1772 - DNA, 17 bp, Artificial sequence
  Synthesized sequence
agggcacgggggtggcc

SEQ ID NO: 1773 - DNA, 17 bp, Artificial sequence
  Synthesized sequence
ctggcacgaaggtcacc

SEQ ID NO: 1774 - DNA, 17 bp, Artificial sequence
  Synthesized sequence
gtggcccgctacctgat

SEQ ID NO: 1775 - DNA, 17 bp, Artificial sequence
  Synthesized sequence
ctggcgctggacatgcg

SEQ ID NO: 1776 - DNA, 17 bp, Artificial sequence
  Synthesized sequence
gtggcaggggaactgga

SEQ ID NO: 1777 - DNA, 17 bp, Artificial sequence
  Synthesized sequence
gtggcactggtgcggcg

SEQ ID NO: 1778 - DNA, 17 bp, Artificial sequence
  Synthesized sequence
ttggcacggaacgcgtt

SEQ ID NO: 1779 - DNA, 17 bp, Artificial sequence
  Synthesized sequence
ctggcaatctctatgcc

SEQ ID NO: 1780 - DNA, 17 bp, Artificial sequence
  Synthesized sequence
ctggcaatctctatgcc

SEQ ID NO: 1781 - DNA, 17 bp, Artificial sequence
  Synthesized sequence
gaggcagagcaggtgca

SEQ ID NO: 1782 - DNA, 17 bp, Artificial sequence
  Synthesized sequence
ctggccggcctgctgcg

SEQ ID NO: 1783 - DNA, 17 bp, Artificial sequence
  Synthesized sequence
ctggaacttgcctggct

SEQ ID NO: 1784 - DNA, 17 bp, Artificial sequence
  Synthesized sequence
taggcacggcaagcgca

SEQ ID NO: 1785 - DNA, 17 bp, Artificial sequence
  Synthesized sequence
ctggcagatctgccgct

SEQ ID NO: 1786 - DNA, 17 bp, Artificial sequence
  Synthesized sequence
ccggcttgggtcttgcc

SEQ ID NO: 1787 - DNA, 17 bp, Artificial sequence
  Synthesized sequence
ctggaaggcatcctgcc

SEQ ID NO: 1788 - DNA, 17 bp, Artificial sequence
  Synthesized sequence
ctgccgctgacgttgca

SEQ ID NO: 1789 - DNA, 17 bp, Artificial sequence
  Synthesized sequence
caggtacgctgcctgct

SEQ ID NO: 1790 - DNA, 17 bp, Artificial sequence
  Synthesized sequence
ctgctgcggccgttgct

SEQ ID NO: 1791 - DNA, 17 bp, Artificial sequence
  Synthesized sequence
ctggccgacagcctgca

SEQ ID NO: 1792 - DNA, 17 bp, Artificial sequence
  Synthesized sequence
atggcctggccatcgcc

SEQ ID NO: 1793 - DNA, 17 bp, Artificial sequence
  Synthesized sequence
gcggcacagcactttcc

SEQ ID NO: 1794 - DNA, 17 bp, Artificial sequence
  Synthesized sequence
gtggccacggtgctgct

SEQ ID NO: 1795 - DNA, 17 bp, Artificial sequence
  Synthesized sequence
atggtctgtttcttgcc

SEQ ID NO: 1796 - DNA, 17 bp, Artificial sequence
  Synthesized sequence
caggctcgccgcctgct

SEQ ID NO: 1797 - DNA, 17 bp, Artificial sequence
  Synthesized sequence
ctggccgggctttggcg

SEQ ID NO: 1798 - DNA, 17 bp, Artificial sequence
  Synthesized sequence
tcggcgcctggtttgct

SEQ ID NO: 1799 - DNA, 17 bp, Artificial sequence
  Synthesized sequence
gcggcacgccacgggct

SEQ ID NO: 1800 - DNA, 17 bp, Artificial sequence
  Synthesized sequence
atcgaacgctggttgcg

SEQ ID NO: 1801 - DNA, 17 bp, Artificial sequence
  Synthesized sequence
ccggtacagcgcgtgct

SEQ ID NO: 1802 - DNA, 17 bp, Artificial sequence
  Synthesized sequence
tcggtacagcaactgct

SEQ ID NO: 1803 - DNA, 17 bp, Artificial sequence
  Synthesized sequence
gtggcatcggtggcgct

SEQ ID NO: 1804 - DNA, 17 bp, Artificial sequence
  Synthesized sequence
ctggcgccgggcctgcc

SEQ ID NO: 1805 - DNA, 17 bp, Artificial sequence
  Synthesized sequence
ctggcaaggcgctatct

SEQ ID NO: 1806 - DNA, 17 bp, Artificial sequence
  Synthesized sequence
ctggaaggccagttcca

SEQ ID NO: 1807 - DNA, 17 bp, Artificial sequence
  Synthesized sequence
ctggcggaagccctgca

SEQ ID NO: 1808 - DNA, 17 bp, Artificial sequence
  Synthesized sequence
cgggcgcagggtttgcg

SEQ ID NO: 1809 - DNA, 17 bp, Artificial sequence
  Synthesized sequence
tcggcacggccaaggct

SEQ ID NO: 1810 - DNA, 17 bp, Artificial sequence
  Synthesized sequence
ttgccaccccacttgaa

SEQ ID NO: 1811 - DNA, 17 bp, Artificial sequence
  Synthesized sequence
ctggtaccggtcttgac

SEQ ID NO: 1812 - DNA, 17 bp, Artificial sequence
  Synthesized sequence
cagggaggggcattgca

SEQ ID NO: 1813 - DNA, 17 bp, Artificial sequence
  Synthesized sequence
tcggcaagggctttgtt

SEQ ID NO: 1814 - DNA, 17 bp, Artificial sequence
  Synthesized sequence
caggcgcaactgctgct

SEQ ID NO: 1815 - DNA, 17 bp, Artificial sequence
  Synthesized sequence
gtggaacgggtgcggca

SEQ ID NO: 1816 - DNA, 17 bp, Artificial sequence
  Synthesized sequence
ctggcgatgcccctgct

SEQ ID NO: 1817 - DNA, 17 bp, Artificial sequence
  Synthesized sequence
gtggtagtgatgatgca

SEQ ID NO: 1818 - DNA, 17 bp, Artificial sequence
  Synthesized sequence
ctggagcgcccgctgca

SEQ ID NO: 1819 - DNA, 17 bp, Artificial sequence
  Synthesized sequence
ctggccaaggccctgca

SEQ ID NO: 1820 - DNA, 17 bp, Artificial sequence
  Synthesized sequence
ctggaagcggtgctgct

SEQ ID NO: 1821 - DNA, 17 bp, Artificial sequence
  Synthesized sequence
ctggcgccgtcggtgcg

SEQ ID NO: 1822 - DNA, 17 bp, Artificial sequence
  Synthesized sequence
cgggcgcgactctagca

SEQ ID NO: 1823 - DNA, 17 bp, Artificial sequence
  Synthesized sequence
ctggtcctggccttgcc

SEQ ID NO: 1824 - DNA, 17 bp, Artificial sequence
  Synthesized sequence
ctggccatgtacctgca

SEQ ID NO: 1825 - DNA, 17 bp, Artificial sequence
  Synthesized sequence
ctggcgcgaggacggct

SEQ ID NO: 1826 - DNA, 17 bp, Artificial sequence
  Synthesized sequence
aagtcacgcatcatgct

SEQ ID NO: 1827 - DNA, 17 bp, Artificial sequence
  Synthesized sequence
gccgcgcggctgttgca

SEQ ID NO: 1828 - DNA, 17 bp, Artificial sequence
  Synthesized sequence
atagcgtatcccttgct

SEQ ID NO: 1829 - DNA, 17 bp, Artificial sequence
  Synthesized sequence
ctggcgcggatccagcg

SEQ ID NO: 1830 - DNA, 17 bp, Artificial sequence
  Synthesized sequence
gtggcgtggaagtcgcc

SEQ ID NO: 1831 - DNA, 17 bp, Artificial sequence
  Synthesized sequence
gcgccgcgcctgttgct

SEQ ID NO: 1832 - DNA, 17 bp, Artificial sequence
  Synthesized sequence
gtggcgccaccgtcgcg

SEQ ID NO: 1833 - DNA, 17 bp, Artificial sequence
  Synthesized sequence
ggggcaggcggctggct

SEQ ID NO: 1834 - DNA, 17 bp, Artificial sequence
  Synthesized sequence
ctggcgacggccctgct

SEQ ID NO: 1835 - DNA, 17 bp, Artificial sequence
  Synthesized sequence
ctggtcctcctgctgct

SEQ ID NO: 1836 - DNA, 17 bp, Artificial sequence
  Synthesized sequence
ctggtgctggtcctgct

SEQ ID NO: 1837 - DNA, 17 bp, Artificial sequence
  Synthesized sequence
ctggacctgcgcctgct

SEQ ID NO: 1838 - DNA, 17 bp, Artificial sequence
  Synthesized sequence
ctggccggcccgctgcg

SEQ ID NO: 1839 - DNA, 17 bp, Artificial sequence
  Synthesized sequence
ctggtgcgggtcctgcc

SEQ ID NO: 1840 - DNA, 17 bp, Artificial sequence
  Synthesized sequence
ctggcactcaggtggga

SEQ ID NO: 1841 - DNA, 17 bp, Artificial sequence
  Synthesized sequence
ctgggatgctgggtgcg

SEQ ID NO: 1842 - DNA, 17 bp, Artificial sequence
  Synthesized sequence
atggccgcggtgatgct

SEQ ID NO: 1843 - DNA, 17 bp, Artificial sequence
  Synthesized sequence
ctggagcggatgatgcg

SEQ ID NO: 1844 - DNA, 17 bp, Artificial sequence
  Synthesized sequence
ctggccaacgaggtgct

SEQ ID NO: 1845 - DNA, 17 bp, Artificial sequence
  Synthesized sequence
ctggacagcgacttgcg

SEQ ID NO: 1846 - DNA, 17 bp, Artificial sequence
  Synthesized sequence
atgccagacggcttgcc

SEQ ID NO: 1847 - DNA, 17 bp, Artificial sequence
  Synthesized sequence
ctggagcggcatgtgcg

SEQ ID NO: 1848 - DNA, 17 bp, Artificial sequence
  Synthesized sequence
atggcccggcgtgtcca

SEQ ID NO: 1849 - DNA, 17 bp, Artificial sequence
  Synthesized sequence
ctggcaggacgatttat

SEQ ID NO: 1850 - DNA, 17 bp, Artificial sequence
  Synthesized sequence
ctggcaggacgatttat

SEQ ID NO: 1851 - DNA, 17 bp, Artificial sequence
  Synthesized sequence
ctgtcatgcctggtgcg

SEQ ID NO: 1852 - DNA, 17 bp, Artificial sequence
  Synthesized sequence
ctggagcgcccgttgat

SEQ ID NO: 1853 - DNA, 17 bp, Artificial sequence
  Synthesized sequence
ctggcggtggtgatgct

SEQ ID NO: 1854 - DNA, 17 bp, Artificial sequence
  Synthesized sequence
ttggcgagaatgatgcc

SEQ ID NO: 1855 - DNA, 17 bp, Artificial sequence
  Synthesized sequence
caggaaggctggttgca

SEQ ID NO: 1856 - DNA, 17 bp, Artificial sequence
  Synthesized sequence
ctggccggacgcatgcc

SEQ ID NO: 1857 - DNA, 17 bp, Artificial sequence
  Synthesized sequence
ttggccgaactcatgcc

SEQ ID NO: 1858 - DNA, 17 bp, Artificial sequence
  Synthesized sequence
ttcgccggggaattgca

SEQ ID NO: 1859 - DNA, 17 bp, Artificial sequence
  Synthesized sequence
gcggcattctacctgct

SEQ ID NO: 1860 - DNA, 17 bp, Artificial sequence
  Synthesized sequence
ctggccgacgtttcgca

SEQ ID NO: 1861 - DNA, 17 bp, Artificial sequence
  Synthesized sequence
atggccagcgacctgcg

SEQ ID NO: 1862 - DNA, 17 bp, Artificial sequence
  Synthesized sequence
gcggcatggtcactgcg

SEQ ID NO: 1863 - DNA, 17 bp, Artificial sequence
  Synthesized sequence
ctggagcggcgcctgcc

SEQ ID NO: 1864 - DNA, 17 bp, Artificial sequence
  Synthesized sequence
ctggcgcagcgcctggt

SEQ ID NO: 1865 - DNA, 17 bp, Artificial sequence
  Synthesized sequence
ctggtctgggtgctgct

SEQ ID NO: 1866 - DNA, 17 bp, Artificial sequence
  Synthesized sequence
ctggtctgggtgctgct

SEQ ID NO: 1867 - DNA, 17 bp, Artificial sequence
  Synthesized sequence
gtggccaagggttggct

SEQ ID NO: 1868 - DNA, 17 bp, Artificial sequence
  Synthesized sequence
cgggcgaagtcgttgct

SEQ ID NO: 1869 - DNA, 17 bp, Artificial sequence
  Synthesized sequence
cgggcatatcgactgca

SEQ ID NO: 1870 - DNA, 17 bp, Artificial sequence
  Synthesized sequence
gtggtctggaccctgct

SEQ ID NO: 1871 - DNA, 17 bp, Artificial sequence
  Synthesized sequence
ttgatacaggcattgcc

SEQ ID NO: 1872 - DNA, 17 bp, Artificial sequence
  Synthesized sequence
gttgctcgggttgtgct

SEQ ID NO: 1873 - DNA, 17 bp, Artificial sequence
  Synthesized sequence
ctcgcaaggaacttgaa

SEQ ID NO: 1874 - DNA, 17 bp, Artificial sequence
  Synthesized sequence
gatgcacggctcttcct

SEQ ID NO: 1875 - DNA, 17 bp, Artificial sequence
  Synthesized sequence
aaggctcgcggcctgct

SEQ ID NO: 1876 - DNA, 17 bp, Artificial sequence
  Synthesized sequence
ctggaacgcccggagca

SEQ ID NO: 1877 - DNA, 17 bp, Artificial sequence
  Synthesized sequence
ctggagcgcctattcca

SEQ ID NO: 1878 - DNA, 17 bp, Artificial sequence
  Synthesized sequence
aaggcgcgcttctggca

SEQ ID NO: 1879 - DNA, 17 bp, Artificial sequence
  Synthesized sequence
agggaatgatgcttgcc

SEQ ID NO: 1880 - DNA, 17 bp, Artificial sequence
  Synthesized sequence
tgggtactgatcctgct

SEQ ID NO: 1881 - DNA, 17 bp, Artificial sequence
  Synthesized sequence
ctggcgggggtgctgcc

SEQ ID NO: 1882 - DNA, 17 bp, Artificial sequence
  Synthesized sequence
ctggcgcgcaatccgca

SEQ ID NO: 1883 - DNA, 17 bp, Artificial sequence
  Synthesized sequence
atgactcgtctcctgct

SEQ ID NO: 1884 - DNA, 17 bp, Artificial sequence
  Synthesized sequence
aaggttcgcgcattgct

SEQ ID NO: 1885 - DNA, 17 bp, Artificial sequence
  Synthesized sequence
aaggttcgcgcattgct

SEQ ID NO: 1886 - DNA, 17 bp, Artificial sequence
  Synthesized sequence
taggcatggcacttgac

SEQ ID NO: 1887 - DNA, 17 bp, Artificial sequence
  Synthesized sequence
ttggcctcgacttcgct

SEQ ID NO: 1888 - DNA, 17 bp, Artificial sequence
  Synthesized sequence
gtggcactgccgaggcg

SEQ ID NO: 1889 - DNA, 17 bp, Artificial sequence
  Synthesized sequence
gtggacggcgtgttgcg

SEQ ID NO: 1890 - DNA, 17 bp, Artificial sequence
  Synthesized sequence
ctggccgacccgatgca

SEQ ID NO: 1891 - DNA, 17 bp, Artificial sequence
  Synthesized sequence
ctggcccaggtcaagca

SEQ ID NO: 1892 - DNA, 17 bp, Artificial sequence
  Synthesized sequence
ctggcacgttgtgtacg

SEQ ID NO: 1893 - DNA, 17 bp, Artificial sequence
  Synthesized sequence
agggcagagcccttggt

SEQ ID NO: 1894 - DNA, 17 bp, Artificial sequence
  Synthesized sequence
atggcggtgttctcgct

SEQ ID NO: 1895 - DNA, 17 bp, Artificial sequence
  Synthesized sequence
ctcgaacggaaggtgca

SEQ ID NO: 1896 - DNA, 17 bp, Artificial sequence
  Synthesized sequence
gtcgcccgccgcctgct

SEQ ID NO: 1897 - DNA, 17 bp, Artificial sequence
  Synthesized sequence
gagggacggatcctgcc

SEQ ID NO: 1898 - DNA, 17 bp, Artificial sequence
  Synthesized sequence
ctggctaggctgttgtg

SEQ ID NO: 1899 - DNA, 17 bp, Artificial sequence
  Synthesized sequence
ttgccagggcggttggt

SEQ ID NO: 1900 - DNA, 17 bp, Artificial sequence
  Synthesized sequence
ctcgcagaacgcctgct

SEQ ID NO: 1901 - DNA, 17 bp, Artificial sequence
  Synthesized sequence
gtggttcggccgtttca

SEQ ID NO: 1902 - DNA, 17 bp, Artificial sequence
  Synthesized sequence
gtggtgcgggtcgtgcc

SEQ ID NO: 1903 - DNA, 17 bp, Artificial sequence
  Synthesized sequence
atggcgcccgccgtgcg

SEQ ID NO: 1904 - DNA, 17 bp, Artificial sequence
  Synthesized sequence
caggaacggcgcttcct

SEQ ID NO: 1905 - DNA, 17 bp, Artificial sequence
  Synthesized sequence
agggcgcgacactggca

SEQ ID NO: 1906 - DNA, 17 bp, Artificial sequence
  Synthesized sequence
gttgatcggcagttgct

SEQ ID NO: 1907 - DNA, 17 bp, Artificial sequence
  Synthesized sequence
ctggcccggccctgtct

SEQ ID NO: 1908 - DNA, 17 bp, Artificial sequence
  Synthesized sequence
ttggcctgaatattccg

SEQ ID NO: 1909 - DNA, 17 bp, Artificial sequence
  Synthesized sequence
ctgcccagccaattgca

SEQ ID NO: 1910 - DNA, 17 bp, Artificial sequence
  Synthesized sequence
ttggcgcgcgccgagct

SEQ ID NO: 1911 - DNA, 17 bp, Artificial sequence
  Synthesized sequence
ctgtgccggcggttgct

SEQ ID NO: 1912 - DNA, 17 bp, Artificial sequence
  Synthesized sequence
acgggacatccattgcg

SEQ ID NO: 1913 - DNA, 17 bp, Artificial sequence
  Synthesized sequence
gtggcgctcgtcttgtg

SEQ ID NO: 1914 - DNA, 17 bp, Artificial sequence
  Synthesized sequence
cgggcacggcagatcct

SEQ ID NO: 1915 - DNA, 17 bp, Artificial sequence
  Synthesized sequence
ttggcctgctggctgcc

SEQ ID NO: 1916 - DNA, 17 bp, Artificial sequence
  Synthesized sequence
ccggtacgcggcctgca

SEQ ID NO: 1917 - DNA, 17 bp, Artificial sequence
  Synthesized sequence
gtggatcacctgatgca

SEQ ID NO: 1918 - DNA, 17 bp, Artificial sequence
  Synthesized sequence
gtggatcacctgatgca

SEQ ID NO: 1919 - DNA, 17 bp, Artificial sequence
  Synthesized sequence
ctggaacacctgccgca

SEQ ID NO: 1920 - DNA, 17 bp, Artificial sequence
  Synthesized sequence
atggccaggtccatgcc

SEQ ID NO: 1921 - DNA, 17 bp, Artificial sequence
  Synthesized sequence
ctggtctggttgctgct

SEQ ID NO: 1922 - DNA, 17 bp, Artificial sequence
  Synthesized sequence
atgaccgacctgttgct

SEQ ID NO: 1923 - DNA, 17 bp, Artificial sequence
  Synthesized sequence
gtggccttcggcctgct

SEQ ID NO: 1924 - DNA, 17 bp, Artificial sequence
  Synthesized sequence
gcggcttgccgcttgcc

SEQ ID NO: 1925 - DNA, 17 bp, Artificial sequence
  Synthesized sequence
caggccggcgcgttgca

SEQ ID NO: 1926 - DNA, 17 bp, Artificial sequence
  Synthesized sequence
gtggccaaatgctggct

SEQ ID NO: 1927 - DNA, 17 bp, Artificial sequence
  Synthesized sequence
caggcccgcctcgtgcg

SEQ ID NO: 1928 - DNA, 17 bp, Artificial sequence
  Synthesized sequence
ctggccaggcggctgcc

SEQ ID NO: 1929 - DNA, 17 bp, Artificial sequence
  Synthesized sequence
aaggaacagccgctgct

SEQ ID NO: 1930 - DNA, 17 bp, Artificial sequence
  Synthesized sequence
ctggttcggcgcctgcc

SEQ ID NO: 1931 - DNA, 17 bp, Artificial sequence
  Synthesized sequence
aagccacgctgattgcg

SEQ ID NO: 1932 - DNA, 17 bp, Artificial sequence
  Synthesized sequence
ctggtcatggccttgct

SEQ ID NO: 1933 - DNA, 17 bp, Artificial sequence
  Synthesized sequence
tcggcgaggtttttgcc

SEQ ID NO: 1934 - DNA, 17 bp, Artificial sequence
  Synthesized sequence
tcggcgaggtttttgcc

SEQ ID NO: 1935 - DNA, 17 bp, Artificial sequence
  Synthesized sequence
acgacacgactctcgca

SEQ ID NO: 1936 - DNA, 17 bp, Artificial sequence
  Synthesized sequence
ttggctggcgcgtggct

SEQ ID NO: 1937 - DNA, 17 bp, Artificial sequence
  Synthesized sequence
atggcattgttctcgta

SEQ ID NO: 1938 - DNA, 17 bp, Artificial sequence
  Synthesized sequence
cgggcgtggtgcttgcc

SEQ ID NO: 1939 - DNA, 17 bp, Artificial sequence
  Synthesized sequence
atggcatggaacatccg

SEQ ID NO: 1940 - DNA, 17 bp, Artificial sequence
  Synthesized sequence
tcggcgcggcccttgga

SEQ ID NO: 1941 - DNA, 17 bp, Artificial sequence
  Synthesized sequence
gttgcacgctagttggg

SEQ ID NO: 1942 - DNA, 17 bp, Artificial sequence
  Synthesized sequence
ctggcccgggcgctgta

SEQ ID NO: 1943 - DNA, 17 bp, Artificial sequence
  Synthesized sequence
ctggccgcccgcctgct

SEQ ID NO: 1944 - DNA, 17 bp, Artificial sequence
  Synthesized sequence
ttggccaggaccatgcc

SEQ ID NO: 1945 - DNA, 17 bp, Artificial sequence
  Synthesized sequence
gtggcctggagatcgcc

SEQ ID NO: 1946 - DNA, 17 bp, Artificial sequence
  Synthesized sequence
ctggcggtgccgctgct

SEQ ID NO: 1947 - DNA, 17 bp, Artificial sequence
  Synthesized sequence
tgggcgagggtcttgcg

SEQ ID NO: 1948 - DNA, 17 bp, Artificial sequence
  Synthesized sequence
ctggaatacgccttcct

SEQ ID NO: 1949 - DNA, 17 bp, Artificial sequence
  Synthesized sequence
atggtatcggcctggct

SEQ ID NO: 1950 - DNA, 17 bp, Artificial sequence
  Synthesized sequence
ctggccatggacctgca

SEQ ID NO: 1951 - DNA, 17 bp, Artificial sequence
  Synthesized sequence
ctgccacgcagttcgcc

SEQ ID NO: 1952 - DNA, 17 bp, Artificial sequence
  Synthesized sequence
atggcgaggcgagtgcg

SEQ ID NO: 1953 - DNA, 17 bp, Artificial sequence
  Synthesized sequence
gtggaaaagcacctgcg

SEQ ID NO: 1954 - DNA, 17 bp, Artificial sequence
  Synthesized sequence
ctggtccggttgctgcc

SEQ ID NO: 1955 - DNA, 17 bp, Artificial sequence
  Synthesized sequence
cgggttcaggttttgct

SEQ ID NO: 1956 - DNA, 17 bp, Artificial sequence
  Synthesized sequence
ctggaaagccgcctgcg

SEQ ID NO: 1957 - DNA, 17 bp, Artificial sequence
  Synthesized sequence
ctggcgcgttgtttccc

SEQ ID NO: 1958 - DNA, 17 bp, Artificial sequence
  Synthesized sequence
caggcgcacatggtgct

SEQ ID NO: 1959 - DNA, 17 bp, Artificial sequence
  Synthesized sequence
ttggcatacatgtcgga

SEQ ID NO: 1960 - DNA, 17 bp, Artificial sequence
  Synthesized sequence
ctggcggcctacctgct

SEQ ID NO: 1961 - DNA, 17 bp, Artificial sequence
  Synthesized sequence
ctggccggtgcctggca

SEQ ID NO: 1962 - DNA, 17 bp, Artificial sequence
  Synthesized sequence
ctggcacctgaaaggca

SEQ ID NO: 1963 - DNA, 17 bp, Artificial sequence
  Synthesized sequence
ctggcccgcctgtacct

SEQ ID NO: 1964 - DNA, 17 bp, Artificial sequence
  Synthesized sequence
ctggccacgctgttcct

SEQ ID NO: 1965 - DNA, 17 bp, Artificial sequence
  Synthesized sequence
ctggaagggccgctgcc

SEQ ID NO: 1966 - DNA, 17 bp, Artificial sequence
  Synthesized sequence
ttgctgcgccagttgct

SEQ ID NO: 1967 - DNA, 17 bp, Artificial sequence
  Synthesized sequence
tcggcatggtcctggcg

SEQ ID NO: 1968 - DNA, 17 bp, Artificial sequence
  Synthesized sequence
ctggcccgcaccctgga

SEQ ID NO: 1969 - DNA, 17 bp, Artificial sequence
  Synthesized sequence
gaggcacgccggcggct

SEQ ID NO: 1970 - DNA, 17 bp, Artificial sequence
  Synthesized sequence
ctggaacgccaagggca

SEQ ID NO: 1971 - DNA, 17 bp, Artificial sequence
  Synthesized sequence
tttgctcagctcctgca

SEQ ID NO: 1972 - DNA, 17 bp, Artificial sequence
  Synthesized sequence
ttggcagagcgagcgca

SEQ ID NO: 1973 - DNA, 17 bp, Artificial sequence
  Synthesized sequence
atggcccccaggctgcg

SEQ ID NO: 1974 - DNA, 17 bp, Artificial sequence
  Synthesized sequence
ctggccgtacgcctgca

SEQ ID NO: 1975 - DNA, 17 bp, Artificial sequence
  Synthesized sequence
ctggaaaccaccctgct

SEQ ID NO: 1976 - DNA, 17 bp, Artificial sequence
  Synthesized sequence
gtagccctctcgttgca

SEQ ID NO: 1977 - DNA, 17 bp, Artificial sequence
  Synthesized sequence
ttgcaacgcatactgca

SEQ ID NO: 1978 - DNA, 17 bp, Artificial sequence
  Synthesized sequence
ctggaaagcagcctgcg

SEQ ID NO: 1979 - DNA, 17 bp, Artificial sequence
  Synthesized sequence
ctggtgcggaccctgcg

SEQ ID NO: 1980 - DNA, 17 bp, Artificial sequence
  Synthesized sequence
aaggcgttccagttgct

SEQ ID NO: 1981 - DNA, 17 bp, Artificial sequence
  Synthesized sequence
ctggcgaggcgctggcg

SEQ ID NO: 1982 - DNA, 17 bp, Artificial sequence
  Synthesized sequence
aaggcacgcatcgtcct

SEQ ID NO: 1983 - DNA, 17 bp, Artificial sequence
  Synthesized sequence
tcggcacgcggtttggc

SEQ ID NO: 1984 - DNA, 17 bp, Artificial sequence
  Synthesized sequence
gcggcaaggatttcgcg

SEQ ID NO: 1985 - DNA, 17 bp, Artificial sequence
  Synthesized sequence
atggccatcgtcctgct

SEQ ID NO: 1986 - DNA, 17 bp, Artificial sequence
  Synthesized sequence
gcggccggacgcttgcg

SEQ ID NO: 1987 - DNA, 17 bp, Artificial sequence
  Synthesized sequence
ctggccctcacgctgcc

SEQ ID NO: 1988 - DNA, 17 bp, Artificial sequence
  Synthesized sequence
ctggccctcacgctgcc

SEQ ID NO: 1989 - DNA, 17 bp, Artificial sequence
  Synthesized sequence
ctgtgccggcagttgca

SEQ ID NO: 1990 - DNA, 17 bp, Artificial sequence
  Synthesized sequence
ctggcggaaatgtggca

SEQ ID NO: 1991 - DNA, 17 bp, Artificial sequence
  Synthesized sequence
aaggcctggggcttgcc

SEQ ID NO: 1992 - DNA, 17 bp, Artificial sequence
  Synthesized sequence
ctgccccgcgggttgcc

SEQ ID NO: 1993 - DNA, 17 bp, Artificial sequence
  Synthesized sequence
acggcacgcatgccgca

SEQ ID NO: 1994 - DNA, 17 bp, Artificial sequence
  Synthesized sequence
acggcacgcatgccgca

SEQ ID NO: 1995 - DNA, 17 bp, Artificial sequence
  Synthesized sequence
ctggttcgccttgtgcg

SEQ ID NO: 1996 - DNA, 17 bp, Artificial sequence
  Synthesized sequence
caggcatgcgggttcct

SEQ ID NO: 1997 - DNA, 17 bp, Artificial sequence
  Synthesized sequence
ctggccaacgcgatgct

SEQ ID NO: 1998 - DNA, 17 bp, Artificial sequence
  Synthesized sequence
ttcgtacggcgctggca

SEQ ID NO: 1999 - DNA, 17 bp, Artificial sequence
  Synthesized sequence
atggcaaagagacagct

SEQ ID NO: 2000 - DNA, 17 bp, Artificial sequence
  Synthesized sequence
ctggcccgctggctgat

SEQ ID NO: 2001 - DNA, 17 bp, Artificial sequence
  Synthesized sequence
ctggtaccggacttgtg

SEQ ID NO: 2002 - DNA, 17 bp, Artificial sequence
  Synthesized sequence
ctggctctcggatggca

SEQ ID NO: 2003 - DNA, 17 bp, Artificial sequence
  Synthesized sequence
ctggcatcggccgagct

SEQ ID NO: 2004 - DNA, 17 bp, Artificial sequence
  Synthesized sequence
atcgcctgcttcttgcc

SEQ ID NO: 2005 - DNA, 17 bp, Artificial sequence
  Synthesized sequence
atggcaaggtagtggaa

SEQ ID NO: 2006 - DNA, 17 bp, Artificial sequence
  Synthesized sequence
atggccaggccgatgcc

SEQ ID NO: 2007 - DNA, 17 bp, Artificial sequence
  Synthesized sequence
ccggcagccgagttgcc

SEQ ID NO: 2008 - DNA, 17 bp, Artificial sequence
  Synthesized sequence
tttgcactgtaatagca

SEQ ID NO: 2009 - DNA, 17 bp, Artificial sequence
  Synthesized sequence
ctggagcaggtggtgca

SEQ ID NO: 2010 - DNA, 17 bp, Artificial sequence
  Synthesized sequence
ctggcgctgtcggtgcc

SEQ ID NO: 2011 - DNA, 17 bp, Artificial sequence
  Synthesized sequence
ctgccgcgcttcctgca

SEQ ID NO: 2012 - DNA, 17 bp, Artificial sequence
  Synthesized sequence
ctggctcgccctgggca

SEQ ID NO: 2013 - DNA, 17 bp, Artificial sequence
  Synthesized sequence
ctggcagcggcgtggcc

SEQ ID NO: 2014 - DNA, 17 bp, Artificial sequence
  Synthesized sequence
atggcatgaacccttcg

SEQ ID NO: 2015 - DNA, 17 bp, Artificial sequence
  Synthesized sequence
atggcatgaacccttcg

SEQ ID NO: 2016 - DNA, 17 bp, Artificial sequence
  Synthesized sequence
gtggccgcgcggatgct

SEQ ID NO: 2017 - DNA, 17 bp, Artificial sequence
  Synthesized sequence
gtggcctcggcgatgct

SEQ ID NO: 2018 - DNA, 17 bp, Artificial sequence
  Synthesized sequence
ctggcccaggggttccg

SEQ ID NO: 2019 - DNA, 17 bp, Artificial sequence
  Synthesized sequence
gcggtgcgtgccttgct

SEQ ID NO: 2020 - DNA, 17 bp, Artificial sequence
  Synthesized sequence
ctggcgttcggcgtgct

SEQ ID NO: 2021 - DNA, 17 bp, Artificial sequence
  Synthesized sequence
atggcgagcctttcgcc

SEQ ID NO: 2022 - DNA, 17 bp, Artificial sequence
  Synthesized sequence
ctgacaagcatctttca

SEQ ID NO: 2023 - DNA, 17 bp, Artificial sequence
  Synthesized sequence
gcggcgcgacagtagca

SEQ ID NO: 2024 - DNA, 17 bp, Artificial sequence
  Synthesized sequence
ctgggaaacctcctgcg

SEQ ID NO: 2025 - DNA, 17 bp, Artificial sequence
  Synthesized sequence
ccggcacgcctctggga

SEQ ID NO: 2026 - DNA, 17 bp, Artificial sequence
  Synthesized sequence
atggcactcctctagtg

SEQ ID NO: 2027 - DNA, 17 bp, Artificial sequence
  Synthesized sequence
ctggcgatcatgctgct

SEQ ID NO: 2028 - DNA, 17 bp, Artificial sequence
  Synthesized sequence
ccggcgctgatcctgct

SEQ ID NO: 2029 - DNA, 17 bp, Artificial sequence
  Synthesized sequence
ctggcatgcccgcagcg

SEQ ID NO: 2030 - DNA, 17 bp, Artificial sequence
  Synthesized sequence
atggttcagaaaatgct

SEQ ID NO: 2031 - DNA, 17 bp, Artificial sequence
  Synthesized sequence
ctggcaggcggtgttct

SEQ ID NO: 2032 - DNA, 17 bp, Artificial sequence
  Synthesized sequence
ttcgcaccgctggtgcc

SEQ ID NO: 2033 - DNA, 17 bp, Artificial sequence
  Synthesized sequence
gtgcaacaggggttgcg

SEQ ID NO: 2034 - DNA, 17 bp, Artificial sequence
  Synthesized sequence
attgcccggaatatgca

SEQ ID NO: 2035 - DNA, 17 bp, Artificial sequence
  Synthesized sequence
gcggcaaaaccgctgca

SEQ ID NO: 2036 - DNA, 17 bp, Artificial sequence
  Synthesized sequence
ctggccaacctgttcct

SEQ ID NO: 2037 - DNA, 17 bp, Artificial sequence
  Synthesized sequence
cgcgcccggcaattgct

SEQ ID NO: 2038 - DNA, 17 bp, Artificial sequence
  Synthesized sequence
ctggcgcagcgcctgtt

SEQ ID NO: 2039 - DNA, 17 bp, Artificial sequence
  Synthesized sequence
ccggcacgccacctgaa

SEQ ID NO: 2040 - DNA, 17 bp, Artificial sequence
  Synthesized sequence
tgggcgaagggcttgca

SEQ ID NO: 2041 - DNA, 17 bp, Artificial sequence
  Synthesized sequence
atggcgtgggcatcgcg

SEQ ID NO: 2042 - DNA, 17 bp, Artificial sequence
  Synthesized sequence
gtggtcctgatgctgct

SEQ ID NO: 2043 - DNA, 17 bp, Artificial sequence
  Synthesized sequence
ctggtcgggctgctgct

SEQ ID NO: 2044 - DNA, 17 bp, Artificial sequence
  Synthesized sequence
ctgccgcgccacctgca

SEQ ID NO: 2045 - DNA, 17 bp, Artificial sequence
  Synthesized sequence
ctgtcagggcttctgcg

SEQ ID NO: 2046 - DNA, 17 bp, Artificial sequence
  Synthesized sequence
ctggcacaggcctgggc

SEQ ID NO: 2047 - DNA, 17 bp, Artificial sequence
  Synthesized sequence
ctggcgcaccgattgac

SEQ ID NO: 2048 - DNA, 17 bp, Artificial sequence
  Synthesized sequence
ctggccgcggtggtgca

SEQ ID NO: 2049 - DNA, 17 bp, Artificial sequence
  Synthesized sequence
atggccagggccctgcg

SEQ ID NO: 2050 - DNA, 17 bp, Artificial sequence
  Synthesized sequence
ctggcggacagggtgct

SEQ ID NO: 2051 - DNA, 17 bp, Artificial sequence
  Synthesized sequence
atggaattgggcctgca

SEQ ID NO: 2052 - DNA, 17 bp, Artificial sequence
  Synthesized sequence
ctggccgtggtggtgct

SEQ ID NO: 2053 - DNA, 17 bp, Artificial sequence
  Synthesized sequence
gtggcgcgccaggtgga

SEQ ID NO: 2054 - DNA, 17 bp, Artificial sequence
  Synthesized sequence
ttggaacgaggccttct

SEQ ID NO: 2055 - DNA, 17 bp, Artificial sequence
  Synthesized sequence
atggcatgaccgcggcc

SEQ ID NO: 2056 - DNA, 17 bp, Artificial sequence
  Synthesized sequence
gttgctccgctgttgcc

SEQ ID NO: 2057 - DNA, 17 bp, Artificial sequence
  Synthesized sequence
tttgcacaagccgtgcc

SEQ ID NO: 2058 - DNA, 17 bp, Artificial sequence
  Synthesized sequence
ctggcgcagatcctcca

SEQ ID NO: 2059 - DNA, 17 bp, Artificial sequence
  Synthesized sequence
ctggcgatccgcctgct

SEQ ID NO: 2060 - DNA, 17 bp, Artificial sequence
  Synthesized sequence
ctcgcgcgaccctcgct

SEQ ID NO: 2061 - DNA, 17 bp, Artificial sequence
  Synthesized sequence
ctggccggagccctgcg

SEQ ID NO: 2062 - DNA, 17 bp, Artificial sequence
  Synthesized sequence
gcggcccgcgccctgca

SEQ ID NO: 2063 - DNA, 17 bp, Artificial sequence
  Synthesized sequence
gcggcactgcgaatgcg

SEQ ID NO: 2064 - DNA, 17 bp, Artificial sequence
  Synthesized sequence
atggcgccgcgcttggg

SEQ ID NO: 2065 - DNA, 17 bp, Artificial sequence
  Synthesized sequence
atggcggaccagttgat

SEQ ID NO: 2066 - DNA, 17 bp, Artificial sequence
  Synthesized sequence
gtggccggctcgttcct

SEQ ID NO: 2067 - DNA, 17 bp, Artificial sequence
  Synthesized sequence
gtggtgcgcttcctgcc

SEQ ID NO: 2068 - DNA, 17 bp, Artificial sequence
  Synthesized sequence
gtggtgcgcttcctgcc

SEQ ID NO: 2069 - DNA, 17 bp, Artificial sequence
  Synthesized sequence
ctggccgagcacctgcg

SEQ ID NO: 2070 - DNA, 17 bp, Artificial sequence
  Synthesized sequence
gtggaacgcggcgagct

SEQ ID NO: 2071 - DNA, 17 bp, Artificial sequence
  Synthesized sequence
ctggttcgcctattcca

SEQ ID NO: 2072 - DNA, 17 bp, Artificial sequence
  Synthesized sequence
gttgcagcgacgttgcg

SEQ ID NO: 2073 - DNA, 17 bp, Artificial sequence
  Synthesized sequence
ctggcgctctgttttca

SEQ ID NO: 2074 - DNA, 17 bp, Artificial sequence
  Synthesized sequence
agggtacggaacttgga

SEQ ID NO: 2075 - DNA, 17 bp, Artificial sequence
  Synthesized sequence
atggcgcggcggatgta

SEQ ID NO: 2076 - DNA, 17 bp, Artificial sequence
  Synthesized sequence
ctggcggccgtcctgca

SEQ ID NO: 2077 - DNA, 17 bp, Artificial sequence
  Synthesized sequence
gtcgcccgcccgctgct

SEQ ID NO: 2078 - DNA, 17 bp, Artificial sequence
  Synthesized sequence
atggcactggctccgcg

SEQ ID NO: 2079 - DNA, 17 bp, Artificial sequence
  Synthesized sequence
aaggcacgcaggtttcc

SEQ ID NO: 2080 - DNA, 17 bp, Artificial sequence
  Synthesized sequence
atcgcaccaaccttcca

SEQ ID NO: 2081 - DNA, 17 bp, Artificial sequence
  Synthesized sequence
acggcatggtcgatgcc

SEQ ID NO: 2082 - DNA, 17 bp, Artificial sequence
  Synthesized sequence
gtggcccgggcacggca

SEQ ID NO: 2083 - DNA, 17 bp, Artificial sequence
  Synthesized sequence
gtggcctgcaactggcg

SEQ ID NO: 2084 - DNA, 17 bp, Artificial sequence
  Synthesized sequence
ctgcaacgcaacgtgct

SEQ ID NO: 2085 - DNA, 17 bp, Artificial sequence
  Synthesized sequence
caggaactgctcctgct

SEQ ID NO: 2086 - DNA, 17 bp, Artificial sequence
  Synthesized sequence
ctggcgatcctgctgca

SEQ ID NO: 2087 - DNA, 17 bp, Artificial sequence
  Synthesized sequence
ctggctggcgtcctgcc

SEQ ID NO: 2088 - DNA, 17 bp, Artificial sequence
  Synthesized sequence
atggcgcgcgacctgga

SEQ ID NO: 2089 - DNA, 17 bp, Artificial sequence
  Synthesized sequence
ttggcccgccggcggca

SEQ ID NO: 2090 - DNA, 17 bp, Artificial sequence
  Synthesized sequence
gtggcaagaccgtggta

SEQ ID NO: 2091 - DNA, 17 bp, Artificial sequence
  Synthesized sequence
tgggaagcgcatttgct

SEQ ID NO: 2092 - DNA, 17 bp, Artificial sequence
  Synthesized sequence
caggtaggttctttgca

SEQ ID NO: 2093 - DNA, 17 bp, Artificial sequence
  Synthesized sequence
atggaaaacctcctgcg

SEQ ID NO: 2094 - DNA, 17 bp, Artificial sequence
  Synthesized sequence
caggtacggttcgtgcg

SEQ ID NO: 2095 - DNA, 17 bp, Artificial sequence
  Synthesized sequence
atggcatagcgtttctt

SEQ ID NO: 2096 - DNA, 17 bp, Artificial sequence
  Synthesized sequence
atggcgcgcattctaca

SEQ ID NO: 2097 - DNA, 17 bp, Artificial sequence
  Synthesized sequence
ctggccagtggactgca

SEQ ID NO: 2098 - DNA, 17 bp, Artificial sequence
  Synthesized sequence
ctggcccagggcttccc

SEQ ID NO: 2099 - DNA, 17 bp, Artificial sequence
  Synthesized sequence
tgagcaggaaccttgca

SEQ ID NO: 2100 - DNA, 17 bp, Artificial sequence
  Synthesized sequence
atggcgaacacctcgct

SEQ ID NO: 2101 - DNA, 17 bp, Artificial sequence
  Synthesized sequence
gcggcccggaacttaca

SEQ ID NO: 2102 - DNA, 17 bp, Artificial sequence
  Synthesized sequence
gtggcgtggtattcgcc

SEQ ID NO: 2103 - DNA, 17 bp, Artificial sequence
  Synthesized sequence
gtggcccaggcgttggc

SEQ ID NO: 2104 - DNA, 17 bp, Artificial sequence
  Synthesized sequence
ctggcaggtcagctcca

SEQ ID NO: 2105 - DNA, 17 bp, Artificial sequence
  Synthesized sequence
ctggccgaacagtcgca

SEQ ID NO: 2106 - DNA, 17 bp, Artificial sequence
  Synthesized sequence
ttggcgcaagcatggcc

SEQ ID NO: 2107 - DNA, 17 bp, Artificial sequence
  Synthesized sequence
agggcatcgatgtcgct

SEQ ID NO: 2108 - DNA, 17 bp, Artificial sequence
  Synthesized sequence
tgggcatggatatggcg

SEQ ID NO: 2109 - DNA, 17 bp, Artificial sequence
  Synthesized sequence
atgacaatgcggttgcg

SEQ ID NO: 2110 - DNA, 17 bp, Artificial sequence
  Synthesized sequence
atggccgtggccctgct

SEQ ID NO: 2111 - DNA, 17 bp, Artificial sequence
  Synthesized sequence
tgcgcacagcgcttgcc

SEQ ID NO: 2112 - DNA, 17 bp, Artificial sequence
  Synthesized sequence
ctcgaacgccccgtgca

SEQ ID NO: 2113 - DNA, 17 bp, Artificial sequence
  Synthesized sequence
ctggatcggctgctgcc

SEQ ID NO: 2114 - DNA, 17 bp, Artificial sequence
  Synthesized sequence
gtggcgcctgacctgcg

SEQ ID NO: 2115 - DNA, 17 bp, Artificial sequence
  Synthesized sequence
atggatcgcatcctgcg

SEQ ID NO: 2116 - DNA, 17 bp, Artificial sequence
  Synthesized sequence
acggcccgcgggctgct

SEQ ID NO: 2117 - DNA, 17 bp, Artificial sequence
  Synthesized sequence
ctggaaaccctgctgca

SEQ ID NO: 2118 - DNA, 17 bp, Artificial sequence
  Synthesized sequence
ctggcttcggcgatgct

SEQ ID NO: 2119 - DNA, 17 bp, Artificial sequence
  Synthesized sequence
aaggcgcgcttgttgtt

SEQ ID NO: 2120 - DNA, 17 bp, Artificial sequence
  Synthesized sequence
atggtgctggcgttgcc

SEQ ID NO: 2121 - DNA, 17 bp, Artificial sequence
  Synthesized sequence
ctggtgcgtgccatgca

SEQ ID NO: 2122 - DNA, 17 bp, Artificial sequence
  Synthesized sequence
gtggaacgccgcatcct

SEQ ID NO: 2123 - DNA, 17 bp, Artificial sequence
  Synthesized sequence
caggcccagcgcctgca

SEQ ID NO: 2124 - DNA, 17 bp, Artificial sequence
  Synthesized sequence
gtggcgccgacgtcgcc

SEQ ID NO: 2125 - DNA, 17 bp, Artificial sequence
  Synthesized sequence
gtgccaccagcatggct

SEQ ID NO: 2126 - DNA, 17 bp, Artificial sequence
  Synthesized sequence
ctggcccagcgcctggt

SEQ ID NO: 2127 - DNA, 17 bp, Artificial sequence
  Synthesized sequence
gcggcgatgcgcttgct

SEQ ID NO: 2128 - DNA, 17 bp, Artificial sequence
  Synthesized sequence
gtggccgccctctggca

SEQ ID NO: 2129 - DNA, 17 bp, Artificial sequence
  Synthesized sequence
ctggcccgggaactggt

SEQ ID NO: 2130 - DNA, 17 bp, Artificial sequence
  Synthesized sequence
ttggcgcaggggtttcg

SEQ ID NO: 2131 - DNA, 17 bp, Artificial sequence
  Synthesized sequence
gaggcgcgcgggctgct

SEQ ID NO: 2132 - DNA, 17 bp, Artificial sequence
  Synthesized sequence
gtcgcatgccgatagca

SEQ ID NO: 2133 - DNA, 17 bp, Artificial sequence
  Synthesized sequence
atcgcccgggcgctgct

SEQ ID NO: 2134 - DNA, 17 bp, Artificial sequence
  Synthesized sequence
ctggcccaggtcaagct

SEQ ID NO: 2135 - DNA, 17 bp, Artificial sequence
  Synthesized sequence
ttggtcctgttgctgct

SEQ ID NO: 2136 - DNA, 17 bp, Artificial sequence
  Synthesized sequence
ctggcgcgggccctgga

SEQ ID NO: 2137 - DNA, 17 bp, Artificial sequence
  Synthesized sequence
ctcgaccgacagttgca

SEQ ID NO: 2138 - DNA, 17 bp, Artificial sequence
  Synthesized sequence
gaggcgcgcaagctgca

SEQ ID NO: 2139 - DNA, 17 bp, Artificial sequence
  Synthesized sequence
atggccgtggtgatgct

SEQ ID NO: 2140 - DNA, 17 bp, Artificial sequence
  Synthesized sequence
ctggcacaatctctccg

SEQ ID NO: 2141 - DNA, 17 bp, Artificial sequence
  Synthesized sequence
tgggcaccgcctatgcc

SEQ ID NO: 2142 - DNA, 17 bp, Artificial sequence
  Synthesized sequence
gaggctcgccggctgct

SEQ ID NO: 2143 - DNA, 17 bp, Artificial sequence
  Synthesized sequence
gtggcgacttccttgcc

SEQ ID NO: 2144 - DNA, 17 bp, Artificial sequence
  Synthesized sequence
taggcatcgcaatcgct

SEQ ID NO: 2145 - DNA, 17 bp, Artificial sequence
  Synthesized sequence
atggagcggcgcatgcg

SEQ ID NO: 2146 - DNA, 17 bp, Artificial sequence
  Synthesized sequence
attgcgcaaaaattgcg

SEQ ID NO: 2147 - DNA, 17 bp, Artificial sequence
  Synthesized sequence
aaggaacaggtcatgca

SEQ ID NO: 2148 - DNA, 17 bp, Artificial sequence
  Synthesized sequence
tcggcgaatttcttgca

SEQ ID NO: 2149 - DNA, 17 bp, Artificial sequence
  Synthesized sequence
ctggcgcaactgctgtt

SEQ ID NO: 2150 - DNA, 17 bp, Artificial sequence
  Synthesized sequence
cgggcatgatcgctgcg

SEQ ID NO: 2151 - DNA, 17 bp, Artificial sequence
  Synthesized sequence
caggcgcgggcactgca

SEQ ID NO: 2152 - DNA, 17 bp, Artificial sequence
  Synthesized sequence
caggccaaggcgttgct

SEQ ID NO: 2153 - DNA, 17 bp, Artificial sequence
  Synthesized sequence
acggcatggccatcgcc

SEQ ID NO: 2154 - DNA, 17 bp, Artificial sequence
  Synthesized sequence
ctgggaggaaagctgcg

SEQ ID NO: 2155 - DNA, 17 bp, Artificial sequence
  Synthesized sequence
ctggtgcgccctttcca

SEQ ID NO: 2156 - DNA, 17 bp, Artificial sequence
  Synthesized sequence
cgggcaaaggtcttgtt

SEQ ID NO: 2157 - DNA, 17 bp, Artificial sequence
  Synthesized sequence
ctggcaaaacgccggca

SEQ ID NO: 2158 - DNA, 17 bp, Artificial sequence
  Synthesized sequence
tcggcaccgcttttccc

SEQ ID NO: 2159 - DNA, 17 bp, Artificial sequence
  Synthesized sequence
ttggcactacccgcgcc

SEQ ID NO: 2160 - DNA, 17 bp, Artificial sequence
  Synthesized sequence
atggatcgcggctcgct

SEQ ID NO: 2161 - DNA, 17 bp, Artificial sequence
  Synthesized sequence
ctggcccgcggcgcgct

SEQ ID NO: 2162 - DNA, 17 bp, Artificial sequence
  Synthesized sequence
ctggccgcgcgggtgct

SEQ ID NO: 2163 - DNA, 17 bp, Artificial sequence
  Synthesized sequence
ttcgcccgccgcctgca

SEQ ID NO: 2164 - DNA, 17 bp, Artificial sequence
  Synthesized sequence
ctggcgctgatcccgct

SEQ ID NO: 2165 - DNA, 17 bp, Artificial sequence
  Synthesized sequence
ctgcaacgctacgtgct

SEQ ID NO: 2166 - DNA, 17 bp, Artificial sequence
  Synthesized sequence
ctggaatggttccggct

SEQ ID NO: 2167 - DNA, 17 bp, Artificial sequence
  Synthesized sequence
atggcgtggcgttcgcc

SEQ ID NO: 2168 - DNA, 17 bp, Artificial sequence
  Synthesized sequence
gtggcgttcgccgtgct

SEQ ID NO: 2169 - DNA, 17 bp, Artificial sequence
  Synthesized sequence
ctggccgtgcgcctgca

SEQ ID NO: 2170 - DNA, 17 bp, Artificial sequence
  Synthesized sequence
taagcaggggagttgct

SEQ ID NO: 2171 - DNA, 17 bp, Artificial sequence
  Synthesized sequence
atggcatggcggatgtg

SEQ ID NO: 2172 - DNA, 17 bp, Artificial sequence
  Synthesized sequence
atggctcgcctcttcat

SEQ ID NO: 2173 - DNA, 17 bp, Artificial sequence
  Synthesized sequence
ctggtgctgaccctgct

SEQ ID NO: 2174 - DNA, 17 bp, Artificial sequence
  Synthesized sequence
gcggcatggccctggcc

SEQ ID NO: 2175 - DNA, 17 bp, Artificial sequence
  Synthesized sequence
gtggcggtcctggtgca

SEQ ID NO: 2176 - DNA, 17 bp, Artificial sequence
  Synthesized sequence
ttgtcgaggggattgct

SEQ ID NO: 2177 - DNA, 17 bp, Artificial sequence
  Synthesized sequence
gtggaccgccagtttct

SEQ ID NO: 2178 - DNA, 17 bp, Artificial sequence
  Synthesized sequence
ctgacacgcctggcgct

SEQ ID NO: 2179 - DNA, 17 bp, Artificial sequence
  Synthesized sequence
gtggccaacaacttcct

SEQ ID NO: 2180 - DNA, 17 bp, Artificial sequence
  Synthesized sequence
ctgtcgcggccgatgct

SEQ ID NO: 2181 - DNA, 17 bp, Artificial sequence
  Synthesized sequence
aaggccttccagttgct

SEQ ID NO: 2182 - DNA, 17 bp, Artificial sequence
  Synthesized sequence
atggcaggcacctggtt

SEQ ID NO: 2183 - DNA, 17 bp, Artificial sequence
  Synthesized sequence
gaggcgcgcctgtggca

SEQ ID NO: 2184 - DNA, 17 bp, Artificial sequence
  Synthesized sequence
ctggttcgaggctggct

SEQ ID NO: 2185 - DNA, 17 bp, Artificial sequence
  Synthesized sequence
gtgggtcggcgatggca

SEQ ID NO: 2186 - DNA, 17 bp, Artificial sequence
  Synthesized sequence
attgaacggatgtcgca

SEQ ID NO: 2187 - DNA, 17 bp, Artificial sequence
  Synthesized sequence
ccggttcgcgaattgct

SEQ ID NO: 2188 - DNA, 17 bp, Artificial sequence
  Synthesized sequence
taggccccctttttgcc

SEQ ID NO: 2189 - DNA, 17 bp, Artificial sequence
  Synthesized sequence
ttgggaaagcccttgta

SEQ ID NO: 2190 - DNA, 17 bp, Artificial sequence
  Synthesized sequence
ctggagcaggcgctgct

SEQ ID NO: 2191 - DNA, 17 bp, Artificial sequence
  Synthesized sequence
ctggaacgcaagctcct

SEQ ID NO: 2192 - DNA, 17 bp, Artificial sequence
  Synthesized sequence
ctgccacacttctggcg

SEQ ID NO: 2193 - DNA, 17 bp, Artificial sequence
  Synthesized sequence
gtcgcacggctactcct

SEQ ID NO: 2194 - DNA, 17 bp, Artificial sequence
  Synthesized sequence
acggcgagggtgttgcg

SEQ ID NO: 2195 - DNA, 17 bp, Artificial sequence
  Synthesized sequence
caggcggcgcgcttgct

SEQ ID NO: 2196 - DNA, 17 bp, Artificial sequence
  Synthesized sequence
ctggcagaatcgcggct

SEQ ID NO: 2197 - DNA, 17 bp, Artificial sequence
  Synthesized sequence
ctggtgctgaccctgct

SEQ ID NO: 2198 - DNA, 17 bp, Artificial sequence
  Synthesized sequence
ctggcgcgctacatcct

SEQ ID NO: 2199 - DNA, 17 bp, Artificial sequence
  Synthesized sequence
tcggcacgtcgatttcg

SEQ ID NO: 2200 - DNA, 17 bp, Artificial sequence
  Synthesized sequence
atggctccgctttttcc

SEQ ID NO: 2201 - DNA, 17 bp, Artificial sequence
  Synthesized sequence
ttggcatagatcgagcg

SEQ ID NO: 2202 - DNA, 17 bp, Artificial sequence
  Synthesized sequence
ctggtacgtgcccagct

SEQ ID NO: 2203 - DNA, 17 bp, Artificial sequence
  Synthesized sequence
acggcacagtgatggcg

SEQ ID NO: 2204 - DNA, 17 bp, Artificial sequence
  Synthesized sequence
atggccttcaaggtgct

SEQ ID NO: 2205 - DNA, 17 bp, Artificial sequence
  Synthesized sequence
ctggaacagaaaccgct

SEQ ID NO: 2206 - DNA, 17 bp, Artificial sequence
  Synthesized sequence
gtggcgctggcctggcg

SEQ ID NO: 2207 - DNA, 17 bp, Artificial sequence
  Synthesized sequence
ttcgcccgctacctgct

SEQ ID NO: 2208 - DNA, 17 bp, Artificial sequence
  Synthesized sequence
gcggcacccattatgcc

SEQ ID NO: 2209 - DNA, 17 bp, Artificial sequence
  Synthesized sequence
gaggcgcagcggctgct

SEQ ID NO: 2210 - DNA, 17 bp, Artificial sequence
  Synthesized sequence
atggcgctgccgtcgcg

SEQ ID NO: 2211 - DNA, 17 bp, Artificial sequence
  Synthesized sequence
ttggcactttcttggat

SEQ ID NO: 2212 - DNA, 17 bp, Artificial sequence
  Synthesized sequence
cagccaggacccttgca

SEQ ID NO: 2213 - DNA, 17 bp, Artificial sequence
  Synthesized sequence
gcggcctggctgatgct

SEQ ID NO: 2214 - DNA, 17 bp, Artificial sequence
  Synthesized sequence
gtgacccgcgtggtgct

SEQ ID NO: 2215 - DNA, 17 bp, Artificial sequence
  Synthesized sequence
ctggtgcgggtcctgcc

SEQ ID NO: 2216 - DNA, 17 bp, Artificial sequence
  Synthesized sequence
atcgcccgccgcgtgct

SEQ ID NO: 2217 - DNA, 17 bp, Artificial sequence
  Synthesized sequence
gtggcgtagctgtagcg

SEQ ID NO: 2218 - DNA, 17 bp, Artificial sequence
  Synthesized sequence
ctggcagaagtcgtcca

SEQ ID NO: 2219 - DNA, 17 bp, Artificial sequence
  Synthesized sequence
gaggatcagcccttgca

SEQ ID NO: 2220 - DNA, 17 bp, Artificial sequence
  Synthesized sequence
cttgcaccggcgtttct

SEQ ID NO: 2221 - DNA, 17 bp, Artificial sequence
  Synthesized sequence
caggtacaggccctgct

SEQ ID NO: 2222 - DNA, 17 bp, Artificial sequence
  Synthesized sequence
caggccctgctcctgca

SEQ ID NO: 2223 - DNA, 17 bp, Artificial sequence
  Synthesized sequence
ctggcaggtggtgcgct

SEQ ID NO: 2224 - DNA, 17 bp, Artificial sequence
  Synthesized sequence
gtggcccgcgccgggct

SEQ ID NO: 2225 - DNA, 17 bp, Artificial sequence
  Synthesized sequence
gtggcatcgacaaggct

SEQ ID NO: 2226 - DNA, 17 bp, Artificial sequence
  Synthesized sequence
atggaaccacattggcg

SEQ ID NO: 2227 - DNA, 17 bp, Artificial sequence
  Synthesized sequence
gtggtccacgtgatgct

SEQ ID NO: 2228 - DNA, 17 bp, Artificial sequence
  Synthesized sequence
gtggccctggcggtgcc

SEQ ID NO: 2229 - DNA, 17 bp, Artificial sequence
  Synthesized sequence
ctggccttccaggtgca

SEQ ID NO: 2230 - DNA, 17 bp, Artificial sequence
  Synthesized sequence
ctgggagtgaccatgct

SEQ ID NO: 2231 - DNA, 17 bp, Artificial sequence
  Synthesized sequence
ctggccaggcagtggcg

SEQ ID NO: 2232 - DNA, 17 bp, Artificial sequence
  Synthesized sequence
aaggcccgcccatggct

SEQ ID NO: 2233 - DNA, 17 bp, Artificial sequence
  Synthesized sequence
cttgcgcaggatttgcg

SEQ ID NO: 2234 - DNA, 17 bp, Artificial sequence
  Synthesized sequence
ctggagaggcggttgcg

SEQ ID NO: 2235 - DNA, 17 bp, Artificial sequence
  Synthesized sequence
ctggcccgggcgctgta

SEQ ID NO: 2236 - DNA, 17 bp, Artificial sequence
  Synthesized sequence
ctcgctcgccaactgct

SEQ ID NO: 2237 - DNA, 17 bp, Artificial sequence
  Synthesized sequence
ctgaccccggtcttgcc

SEQ ID NO: 2238 - DNA, 17 bp, Artificial sequence
  Synthesized sequence
ctggcgctgctcgggct

SEQ ID NO: 2239 - DNA, 17 bp, Artificial sequence
  Synthesized sequence
ctggatcgacgcttcct

SEQ ID NO: 2240 - DNA, 17 bp, Artificial sequence
  Synthesized sequence
tgggcatggccatcgcc

SEQ ID NO: 2241 - DNA, 17 bp, Artificial sequence
  Synthesized sequence
ctggaacgacaggtgga

SEQ ID NO: 2242 - DNA, 17 bp, Artificial sequence
  Synthesized sequence
caggtccaggccttgct

SEQ ID NO: 2243 - DNA, 17 bp, Artificial sequence
  Synthesized sequence
ttggcgttgtggctgct

SEQ ID NO: 2244 - DNA, 17 bp, Artificial sequence
  Synthesized sequence
ccgggacgcgacctgca

SEQ ID NO: 2245 - DNA, 17 bp, Artificial sequence
  Synthesized sequence
ctggcgacccgcctgct

SEQ ID NO: 2246 - DNA, 17 bp, Artificial sequence
  Synthesized sequence
gtggccgccttactgct

SEQ ID NO: 2247 - DNA, 17 bp, Artificial sequence
  Synthesized sequence
gtggccgccttactgct

SEQ ID NO: 2248 - DNA, 17 bp, Artificial sequence
  Synthesized sequence
ctggcgtggtgttcgcc

SEQ ID NO: 2249 - DNA, 17 bp, Artificial sequence
  Synthesized sequence
ctggcgtggtgttcgcc

SEQ ID NO: 2250 - DNA, 17 bp, Artificial sequence
  Synthesized sequence
gcggcaccactttcgcc

SEQ ID NO: 2251 - DNA, 17 bp, Artificial sequence
  Synthesized sequence
ttgtcaccctgatcgct

SEQ ID NO: 2252 - DNA, 17 bp, Artificial sequence
  Synthesized sequence
ttgtcaccctgatcgct

SEQ ID NO: 2253 - DNA, 17 bp, Artificial sequence
  Synthesized sequence
gtggccaggttctggcc

SEQ ID NO: 2254 - DNA, 17 bp, Artificial sequence
  Synthesized sequence
ttggcgaggatgtagcg

SEQ ID NO: 2255 - DNA, 17 bp, Artificial sequence
  Synthesized sequence
ctggcccggcactgcca

SEQ ID NO: 2256 - DNA, 17 bp, Artificial sequence
  Synthesized sequence
ctggcgcaactggtgtt

SEQ ID NO: 2257 - DNA, 17 bp, Artificial sequence
  Synthesized sequence
atggcctgcgcggtgcg

SEQ ID NO: 2258 - DNA, 17 bp, Artificial sequence
  Synthesized sequence
ttggcggtgcgggtgct

SEQ ID NO: 2259 - DNA, 17 bp, Artificial sequence
  Synthesized sequence
atgggatcggcctcgct

SEQ ID NO: 2260 - DNA, 17 bp, Artificial sequence
  Synthesized sequence
ctgggatgcccctcgcc

SEQ ID NO: 2261 - DNA, 17 bp, Artificial sequence
  Synthesized sequence
ctggcggacctgttcct

SEQ ID NO: 2262 - DNA, 17 bp, Artificial sequence
  Synthesized sequence
gtggcgttctgcgtgct

SEQ ID NO: 2263 - DNA, 17 bp, Artificial sequence
  Synthesized sequence
ctggccgacggcgtgca

SEQ ID NO: 2264 - DNA, 17 bp, Artificial sequence
  Synthesized sequence
gtgccgcgactctagca

SEQ ID NO: 2265 - DNA, 17 bp, Artificial sequence
  Synthesized sequence
atggccggctatttcca

SEQ ID NO: 2266 - DNA, 17 bp, Artificial sequence
  Synthesized sequence
gtggcggccatgatgct

SEQ ID NO: 2267 - DNA, 17 bp, Artificial sequence
  Synthesized sequence
ctggaacagaaaccgct

SEQ ID NO: 2268 - DNA, 17 bp, Artificial sequence
  Synthesized sequence
ctggcagcacggttgtc

SEQ ID NO: 2269 - DNA, 17 bp, Artificial sequence
  Synthesized sequence
ttggccaggatgtcgcg

SEQ ID NO: 2270 - DNA, 17 bp, Artificial sequence
  Synthesized sequence
atggaagacgccatgca

SEQ ID NO: 2271 - DNA, 17 bp, Artificial sequence
  Synthesized sequence
atggcattcctccttca

SEQ ID NO: 2272 - DNA, 17 bp, Artificial sequence
  Synthesized sequence
ctggcgcaggtgccgct

SEQ ID NO: 2273 - DNA, 17 bp, Artificial sequence
  Synthesized sequence
gtggcttccaccgtgca

SEQ ID NO: 2274 - DNA, 17 bp, Artificial sequence
  Synthesized sequence
gcggccttgggcttgct

SEQ ID NO: 2275 - DNA, 17 bp, Artificial sequence
  Synthesized sequence
atggcaagctgatcgat

SEQ ID NO: 2276 - DNA, 17 bp, Artificial sequence
  Synthesized sequence
tttgcatggctatcgcc

SEQ ID NO: 2277 - DNA, 17 bp, Artificial sequence
  Synthesized sequence
ctggcacatccagagcg

SEQ ID NO: 2278 - DNA, 17 bp, Artificial sequence
  Synthesized sequence
gtggaaagtctgctgcg

SEQ ID NO: 2279 - DNA, 17 bp, Artificial sequence
  Synthesized sequence
atggagcgtggcctgct

SEQ ID NO: 2280 - DNA, 17 bp, Artificial sequence
  Synthesized sequence
cagggacgcggcatgct

SEQ ID NO: 2281 - DNA, 17 bp, Artificial sequence
  Synthesized sequence
ctggcggcacagatgct

SEQ ID NO: 2282 - DNA, 17 bp, Artificial sequence
  Synthesized sequence
ctggacgatgccttgct

SEQ ID NO: 2283 - DNA, 17 bp, Artificial sequence
  Synthesized sequence
ctggagcaattgctgca

SEQ ID NO: 2284 - DNA, 17 bp, Artificial sequence
  Synthesized sequence
gtggcgcgggacatgga

SEQ ID NO: 2285 - DNA, 17 bp, Artificial sequence
  Synthesized sequence
ctcgcgcggcggatgct

SEQ ID NO: 2286 - DNA, 17 bp, Artificial sequence
  Synthesized sequence
ctggcagacccagcgct

SEQ ID NO: 2287 - DNA, 17 bp, Artificial sequence
  Synthesized sequence
ggagcgcggttcttgca

SEQ ID NO: 2288 - DNA, 17 bp, Artificial sequence
  Synthesized sequence
atcacacaggggttgca

SEQ ID NO: 2289 - DNA, 17 bp, Artificial sequence
  Synthesized sequence
caggcggtccttttgct

SEQ ID NO: 2290 - DNA, 17 bp, Artificial sequence
  Synthesized sequence
ctggcagaaccgctggt

SEQ ID NO: 2291 - DNA, 17 bp, Artificial sequence
  Synthesized sequence
ctggagcgattcctgcg

SEQ ID NO: 2292 - DNA, 17 bp, Artificial sequence
  Synthesized sequence
gtgccacgggcctttcc

SEQ ID NO: 2293 - DNA, 17 bp, Artificial sequence
  Synthesized sequence
ttgacaccccggtggca

SEQ ID NO: 2294 - DNA, 17 bp, Artificial sequence
  Synthesized sequence
ctggcccgagccgttct

SEQ ID NO: 2295 - DNA, 17 bp, Artificial sequence
  Synthesized sequence
acggcatggtcgatgcg

SEQ ID NO: 2296 - DNA, 17 bp, Artificial sequence
  Synthesized sequence
ttgtcaggcgtcttgtt

SEQ ID NO: 2297 - DNA, 17 bp, Artificial sequence
  Synthesized sequence
atggccacctacctgct

SEQ ID NO: 2298 - DNA, 17 bp, Artificial sequence
  Synthesized sequence
atggcgcgtgtcatggt

SEQ ID NO: 2299 - DNA, 17 bp, Artificial sequence
  Synthesized sequence
gtgtcatggtgattggt

SEQ ID NO: 2300 - DNA, 17 bp, Artificial sequence
  Synthesized sequence
ctggcccaggtgctgat

SEQ ID NO: 2301 - DNA, 17 bp, Artificial sequence
  Synthesized sequence
ggggtacatacgttgcg

SEQ ID NO: 2302 - DNA, 17 bp, Artificial sequence
  Synthesized sequence
gcgccgcggcatttgct

SEQ ID NO: 2303 - DNA, 17 bp, Artificial sequence
  Synthesized sequence
acggcaggacacctgcc

SEQ ID NO: 2304 - DNA, 17 bp, Artificial sequence
  Synthesized sequence
ctggcacaaagctggtc

SEQ ID NO: 2305 - DNA, 17 bp, Artificial sequence
  Synthesized sequence
ctggcccaggtgctgat

SEQ ID NO: 2306 - DNA, 17 bp, Artificial sequence
  Synthesized sequence
ccggcacgcgtcgcgca

SEQ ID NO: 2307 - DNA, 17 bp, Artificial sequence
  Synthesized sequence
ctggtgcacatctcgca

SEQ ID NO: 2308 - DNA, 17 bp, Artificial sequence
  Synthesized sequence
ctggctcggaactggat

SEQ ID NO: 2309 - DNA, 17 bp, Artificial sequence
  Synthesized sequence
cgggaacagtatctgct

SEQ ID NO: 2310 - DNA, 17 bp, Artificial sequence
  Synthesized sequence
ctggccaaggttttgta

SEQ ID NO: 2311 - DNA, 17 bp, Artificial sequence
  Synthesized sequence
gtggtccgggtgctgcg

SEQ ID NO: 2312 - DNA, 17 bp, Artificial sequence
  Synthesized sequence
atgggatagcgcgtgcg

SEQ ID NO: 2313 - DNA, 17 bp, Artificial sequence
  Synthesized sequence
gtggagaaggcattgca

SEQ ID NO: 2314 - DNA, 17 bp, Artificial sequence
  Synthesized sequence
cgggcatgaccgatgcc

SEQ ID NO: 2315 - DNA, 17 bp, Artificial sequence
  Synthesized sequence
ctggccgaaggctcgct

SEQ ID NO: 2316 - DNA, 17 bp, Artificial sequence
  Synthesized sequence
atcggacgacaactgct

SEQ ID NO: 2317 - DNA, 17 bp, Artificial sequence
  Synthesized sequence
ctggcgcaggttcggct

SEQ ID NO: 2318 - DNA, 17 bp, Artificial sequence
  Synthesized sequence
atgccgcaggcgttgcg

SEQ ID NO: 2319 - DNA, 17 bp, Artificial sequence
  Synthesized sequence
gtgccgcgcaccctgct

SEQ ID NO: 2320 - DNA, 17 bp, Artificial sequence
  Synthesized sequence
ctggccctggagctgcc

SEQ ID NO: 2321 - DNA, 17 bp, Artificial sequence
  Synthesized sequence
ttggagccggggttgcc

SEQ ID NO: 2322 - DNA, 17 bp, Artificial sequence
  Synthesized sequence
gtggcgcagcacatgtt

SEQ ID NO: 2323 - DNA, 17 bp, Artificial sequence
  Synthesized sequence
ctggtactgatcctgat

SEQ ID NO: 2324 - DNA, 17 bp, Artificial sequence
  Synthesized sequence
gtgggacgacaagggca

SEQ ID NO: 2325 - DNA, 17 bp, Artificial sequence
  Synthesized sequence
cgggcacggtaccggca

SEQ ID NO: 2326 - DNA, 17 bp, Artificial sequence
  Synthesized sequence
ctggctgtattgctgct

SEQ ID NO: 2327 - DNA, 17 bp, Artificial sequence
  Synthesized sequence
agggcaaggtcgttcct

SEQ ID NO: 2328 - DNA, 17 bp, Artificial sequence
  Synthesized sequence
ccggcgtggtgtttgcg

SEQ ID NO: 2329 - DNA, 17 bp, Artificial sequence
  Synthesized sequence
ctggcaggcgctcagca

SEQ ID NO: 2330 - DNA, 17 bp, Artificial sequence
  Synthesized sequence
ttggcgtccttcttgtt

SEQ ID NO: 2331 - DNA, 17 bp, Artificial sequence
  Synthesized sequence
ttgacacccgcggtgca

SEQ ID NO: 2332 - DNA, 17 bp, Artificial sequence
  Synthesized sequence
atcgcccgggcgctgct

SEQ ID NO: 2333 - DNA, 17 bp, Artificial sequence
  Synthesized sequence
tcggcacgagttgttct

SEQ ID NO: 2334 - DNA, 17 bp, Artificial sequence
  Synthesized sequence
ctgggaagtgcctggct

SEQ ID NO: 2335 - DNA, 17 bp, Artificial sequence
  Synthesized sequence
ctggcgcgcaagctgat

SEQ ID NO: 2336 - DNA, 17 bp, Artificial sequence
  Synthesized sequence
ctggcccggcgctacct

SEQ ID NO: 2337 - DNA, 17 bp, Artificial sequence
  Synthesized sequence
caggccttgcgattgct

SEQ ID NO: 2338 - DNA, 17 bp, Artificial sequence
  Synthesized sequence
ctgacaccctggctgca

SEQ ID NO: 2339 - DNA, 17 bp, Artificial sequence
  Synthesized sequence
ctgggcacgcagttgca

SEQ ID NO: 2340 - DNA, 17 bp, Artificial sequence
  Synthesized sequence
ccggcgctgtcgttgcg

SEQ ID NO: 2341 - DNA, 17 bp, Artificial sequence
  Synthesized sequence
gtggctgggcgcctgcc

SEQ ID NO: 2342 - DNA, 17 bp, Artificial sequence
  Synthesized sequence
aaggcctacaggttgca

SEQ ID NO: 2343 - DNA, 17 bp, Artificial sequence
  Synthesized sequence
cttgcgcagctcgtgca

SEQ ID NO: 2344 - DNA, 17 bp, Artificial sequence
  Synthesized sequence
ctgggacgggcgctggt

SEQ ID NO: 2345 - DNA, 17 bp, Artificial sequence
  Synthesized sequence
atggccgggcagatgcc

SEQ ID NO: 2346 - DNA, 17 bp, Artificial sequence
  Synthesized sequence
ctgggccggcgcatgcg

SEQ ID NO: 2347 - DNA, 17 bp, Artificial sequence
  Synthesized sequence
gcggcacatcgctggcg

SEQ ID NO: 2348 - DNA, 17 bp, Artificial sequence
  Synthesized sequence
gtggtgctgaccctgct

SEQ ID NO: 2349 - DNA, 17 bp, Artificial sequence
  Synthesized sequence
ccggcgcggctggtgcg

SEQ ID NO: 2350 - DNA, 17 bp, Artificial sequence
  Synthesized sequence
ctggctgcgcgcgtgct

SEQ ID NO: 2351 - DNA, 17 bp, Artificial sequence
  Synthesized sequence
caggcccaggacgtgct

SEQ ID NO: 2352 - DNA, 17 bp, Artificial sequence
  Synthesized sequence
atggcatgaccggagcc

SEQ ID NO: 2353 - DNA, 17 bp, Artificial sequence
  Synthesized sequence
aaggcacggccttcgat

SEQ ID NO: 2354 - DNA, 17 bp, Artificial sequence
  Synthesized sequence
cggccacgccacctgct

SEQ ID NO: 2355 - DNA, 17 bp, Artificial sequence
  Synthesized sequence
ctgccgcgggtgctgca

SEQ ID NO: 2356 - DNA, 17 bp, Artificial sequence
  Synthesized sequence
gtggcagggcttctccc

SEQ ID NO: 2357 - DNA, 17 bp, Artificial sequence
  Synthesized sequence
ctggccatcgtcctgct

SEQ ID NO: 2358 - DNA, 17 bp, Artificial sequence
  Synthesized sequence
ccggcgctgcaattgcc

SEQ ID NO: 2359 - DNA, 17 bp, Artificial sequence
  Synthesized sequence
gggggacggacgtcgct

SEQ ID NO: 2360 - DNA, 17 bp, Artificial sequence
  Synthesized sequence
ctcgcgctgcgcttgcg

SEQ ID NO: 2361 - DNA, 17 bp, Artificial sequence
  Synthesized sequence
atggggcggattgtgcg

SEQ ID NO: 2362 - DNA, 17 bp, Artificial sequence
  Synthesized sequence
tcggcatacttgttggt

SEQ ID NO: 2363 - DNA, 17 bp, Artificial sequence
  Synthesized sequence
gtggcttgttggtttct

SEQ ID NO: 2364 - DNA, 17 bp, Artificial sequence
  Synthesized sequence
gtggtagatccagtgca

SEQ ID NO: 2365 - DNA, 17 bp, Artificial sequence
  Synthesized sequence
aaggcccagcgtgtgct

SEQ ID NO: 2366 - DNA, 17 bp, Artificial sequence
  Synthesized sequence
atggccgaactcgtgcg

SEQ ID NO: 2367 - DNA, 17 bp, Artificial sequence
  Synthesized sequence
tgggcacggctctggga

SEQ ID NO: 2368 - DNA, 17 bp, Artificial sequence
  Synthesized sequence
gtcgccggccggttgca

SEQ ID NO: 2369 - DNA, 17 bp, Artificial sequence
  Synthesized sequence
ctgggcctgctgctgct

SEQ ID NO: 2370 - DNA, 17 bp, Artificial sequence
  Synthesized sequence
ctgcaacgcgtgctgct

SEQ ID NO: 2371 - DNA, 17 bp, Artificial sequence
  Synthesized sequence
ctgccaaagccgctgct

SEQ ID NO: 2372 - DNA, 17 bp, Artificial sequence
  Synthesized sequence
ttgggaacggtgctgct

SEQ ID NO: 2373 - DNA, 17 bp, Artificial sequence
  Synthesized sequence
ctggccctgcagttgtg

SEQ ID NO: 2374 - DNA, 17 bp, Artificial sequence
  Synthesized sequence
ctggaactgggggtgcc

SEQ ID NO: 2375 - DNA, 17 bp, Artificial sequence
  Synthesized sequence
gtggcgcctgcattact

SEQ ID NO: 2376 - DNA, 17 bp, Artificial sequence
  Synthesized sequence
ctgctatcgccgttgct

SEQ ID NO: 2377 - DNA, 17 bp, Artificial sequence
  Synthesized sequence
ctggcaatcccgtagcc

SEQ ID NO: 2378 - DNA, 17 bp, Artificial sequence
  Synthesized sequence
ctgggcaagcccttgcc

SEQ ID NO: 2379 - DNA, 17 bp, Artificial sequence
  Synthesized sequence
ctggcatgcgataggcg

SEQ ID NO: 2380 - DNA, 17 bp, Artificial sequence
  Synthesized sequence
ctggtagtagtgctgca

SEQ ID NO: 2381 - DNA, 17 bp, Artificial sequence
  Synthesized sequence
aggggatcgtcgttgca

SEQ ID NO: 2382 - DNA, 17 bp, Artificial sequence
  Synthesized sequence
ctggcgcagagcgtgat

SEQ ID NO: 2383 - DNA, 17 bp, Artificial sequence
  Synthesized sequence
atggcctattgatggct

SEQ ID NO: 2384 - DNA, 17 bp, Artificial sequence
  Synthesized sequence
ttcgctcgatccatgca

SEQ ID NO: 2385 - DNA, 17 bp, Artificial sequence
  Synthesized sequence
ctgggaccgcacgcgct

SEQ ID NO: 2386 - DNA, 17 bp, Artificial sequence
  Synthesized sequence
atggcgcagaccatgat

SEQ ID NO: 2387 - DNA, 17 bp, Artificial sequence
  Synthesized sequence
gtgccgcgcctgtcgca

SEQ ID NO: 2388 - DNA, 17 bp, Artificial sequence
  Synthesized sequence
caggcgggtctgttgcg

SEQ ID NO: 2389 - DNA, 17 bp, Artificial sequence
  Synthesized sequence
ccggcaccgccatggcg

SEQ ID NO: 2390 - DNA, 17 bp, Artificial sequence
  Synthesized sequence
tcggcatgaacctggcg

SEQ ID NO: 2391 - DNA, 17 bp, Artificial sequence
  Synthesized sequence
ccggcctgtccgttgcg

SEQ ID NO: 2392 - DNA, 17 bp, Artificial sequence
  Synthesized sequence
caggcagagtaattggt

SEQ ID NO: 2393 - DNA, 17 bp, Artificial sequence
  Synthesized sequence
caggccccgcgcctgct

SEQ ID NO: 2394 - DNA, 17 bp, Artificial sequence
  Synthesized sequence
ttggcgcggtagatcca

SEQ ID NO: 2395 - DNA, 17 bp, Artificial sequence
  Synthesized sequence
gtggcccagccgccgca

SEQ ID NO: 2396 - DNA, 17 bp, Artificial sequence
  Synthesized sequence
gcggcccgggtgctgcg

SEQ ID NO: 2397 - DNA, 17 bp, Artificial sequence
  Synthesized sequence
aaggcatgggtttttcg

SEQ ID NO: 2398 - DNA, 17 bp, Artificial sequence
  Synthesized sequence
ctgccagtgactttgcc

SEQ ID NO: 2399 - DNA, 17 bp, Artificial sequence
  Synthesized sequence
ccggcatgccgctggcg

SEQ ID NO: 2400 - DNA, 17 bp, Artificial sequence
  Synthesized sequence
gctgcaagcaagttgca

SEQ ID NO: 2401 - DNA, 17 bp, Artificial sequence
  Synthesized sequence
ctggaagtaccgctgca

SEQ ID NO: 2402 - DNA, 17 bp, Artificial sequence
  Synthesized sequence
gtggcgcgcaactgcct

SEQ ID NO: 2403 - DNA, 17 bp, Artificial sequence
  Synthesized sequence
atgggacgggttccgcg

SEQ ID NO: 2404 - DNA, 17 bp, Artificial sequence
  Synthesized sequence
ccggcaccgagggtgcc

SEQ ID NO: 2405 - DNA, 17 bp, Artificial sequence
  Synthesized sequence
atgtcgcgtgggttgcg

SEQ ID NO: 2406 - DNA, 17 bp, Artificial sequence
  Synthesized sequence
ctggccctgctcaagca

SEQ ID NO: 2407 - DNA, 17 bp, Artificial sequence
  Synthesized sequence
ctggcactggtgattcc

SEQ ID NO: 2408 - DNA, 17 bp, Artificial sequence
  Synthesized sequence
gacgcagagcgcttgca

SEQ ID NO: 2409 - DNA, 17 bp, Artificial sequence
  Synthesized sequence
ctggccagccgctcgcg

SEQ ID NO: 2410 - DNA, 17 bp, Artificial sequence
  Synthesized sequence
ccggcccggctttggcg

SEQ ID NO: 2411 - DNA, 17 bp, Artificial sequence
  Synthesized sequence
ctggctgccagcctgct

SEQ ID NO: 2412 - DNA, 17 bp, Artificial sequence
  Synthesized sequence
ctggtagcgcttctgcg

SEQ ID NO: 2413 - DNA, 17 bp, Artificial sequence
  Synthesized sequence
ttgccaccctgcttgaa

SEQ ID NO: 2414 - DNA, 17 bp, Artificial sequence
  Synthesized sequence
ctggaaagcgaactgcg

SEQ ID NO: 2415 - DNA, 17 bp, Artificial sequence
  Synthesized sequence
ttgggccagagctggct

SEQ ID NO: 2416 - DNA, 17 bp, Artificial sequence
  Synthesized sequence
ctggcacagccattcgc

SEQ ID NO: 2417 - DNA, 17 bp, Artificial sequence
  Synthesized sequence
ctgacccagtacctgct

SEQ ID NO: 2418 - DNA, 17 bp, Artificial sequence
  Synthesized sequence
ctggcgcatcgtttgtc

SEQ ID NO: 2419 - DNA, 17 bp, Artificial sequence
  Synthesized sequence
gcggcatgcaactcgcc

SEQ ID NO: 2420 - DNA, 17 bp, Artificial sequence
  Synthesized sequence
ccggcgcgccagttgga

SEQ ID NO: 2421 - DNA, 17 bp, Artificial sequence
  Synthesized sequence
atggccctgctcaagca

SEQ ID NO: 2422 - DNA, 17 bp, Artificial sequence
  Synthesized sequence
ctggaagcaccctggct

SEQ ID NO: 2423 - DNA, 17 bp, Artificial sequence
  Synthesized sequence
ctggccgccgccctgct

SEQ ID NO: 2424 - DNA, 17 bp, Artificial sequence
  Synthesized sequence
gtggtgccggtgctgca

SEQ ID NO: 2425 - DNA, 17 bp, Artificial sequence
  Synthesized sequence
ctggccgaggcattggt

SEQ ID NO: 2426 - DNA, 17 bp, Artificial sequence
  Synthesized sequence
atctcacccccattgca

SEQ ID NO: 2427 - DNA, 17 bp, Artificial sequence
  Synthesized sequence
ctggcgaacttcgtgcg

SEQ ID NO: 2428 - DNA, 17 bp, Artificial sequence
  Synthesized sequence
acggcccgacgcctgcg

SEQ ID NO: 2429 - DNA, 17 bp, Artificial sequence
  Synthesized sequence
gcggctcgcgcgctgct

SEQ ID NO: 2430 - DNA, 17 bp, Artificial sequence
  Synthesized sequence
ttgaaaacaatcttgct

SEQ ID NO: 2431 - DNA, 17 bp, Artificial sequence
  Synthesized sequence
ctggccgggacggtgcc

SEQ ID NO: 2432 - DNA, 17 bp, Artificial sequence
  Synthesized sequence
ctggcgctgatcgcgct

SEQ ID NO: 2433 - DNA, 17 bp, Artificial sequence
  Synthesized sequence
ctggccacggcgatgct

SEQ ID NO: 2434 - DNA, 17 bp, Artificial sequence
  Synthesized sequence
gaggcgctgctctggct

SEQ ID NO: 2435 - DNA, 17 bp, Artificial sequence
  Synthesized sequence
gtggcgcgcggtctgat

SEQ ID NO: 2436 - DNA, 17 bp, Artificial sequence
  Synthesized sequence
atggccggctggttcca

SEQ ID NO: 2437 - DNA, 17 bp, Artificial sequence
  Synthesized sequence
ctggcgcggatcgagcg

SEQ ID NO: 2438 - DNA, 17 bp, Artificial sequence
  Synthesized sequence
ctggctcgcgcggcgct

SEQ ID NO: 2439 - DNA, 17 bp, Artificial sequence
  Synthesized sequence
ctggcggaacacctgcg

SEQ ID NO: 2440 - DNA, 17 bp, Artificial sequence
  Synthesized sequence
cgcgaacggcagttgca

SEQ ID NO: 2441 - DNA, 17 bp, Artificial sequence
  Synthesized sequence
atcgaacacctgatgct

SEQ ID NO: 2442 - DNA, 17 bp, Artificial sequence
  Synthesized sequence
ctggcaggtttctaaca

SEQ ID NO: 2443 - DNA, 17 bp, Artificial sequence
  Synthesized sequence
ctggaagggagggtgcc

SEQ ID NO: 2444 - DNA, 17 bp, Artificial sequence
  Synthesized sequence
gtggcgcgcgagaagct

SEQ ID NO: 2445 - DNA, 17 bp, Artificial sequence
  Synthesized sequence
ttggaagtagatctgct

SEQ ID NO: 2446 - DNA, 17 bp, Artificial sequence
  Synthesized sequence
cccgcccggacattgct

SEQ ID NO: 2447 - DNA, 17 bp, Artificial sequence
  Synthesized sequence
atagcctggccattgcc

SEQ ID NO: 2448 - DNA, 17 bp, Artificial sequence
  Synthesized sequence
acggcacggttgtggtt

SEQ ID NO: 2449 - DNA, 17 bp, Artificial sequence
  Synthesized sequence
ttggccgatgccctgca

SEQ ID NO: 2450 - DNA, 17 bp, Artificial sequence
  Synthesized sequence
gtggtccaccacttgga

SEQ ID NO: 2451 - DNA, 17 bp, Artificial sequence
  Synthesized sequence
cttgaattgcaattgca

SEQ ID NO: 2452 - DNA, 17 bp, Artificial sequence
  Synthesized sequence
atggtacgcggcgtgta

SEQ ID NO: 2453 - DNA, 17 bp, Artificial sequence
  Synthesized sequence
gttgcgcaggtcatgct

SEQ ID NO: 2454 - DNA, 17 bp, Artificial sequence
  Synthesized sequence
gaggcacgcgccctgat

SEQ ID NO: 2455 - DNA, 17 bp, Artificial sequence
  Synthesized sequence
ccggcgcggagatcgca

SEQ ID NO: 2456 - DNA, 17 bp, Artificial sequence
  Synthesized sequence
ccggaagcggtgttgca

SEQ ID NO: 2457 - DNA, 17 bp, Artificial sequence
  Synthesized sequence
gtggcctcgtcgttgat

SEQ ID NO: 2458 - DNA, 17 bp, Artificial sequence
  Synthesized sequence
ctggtactgcagccgct

SEQ ID NO: 2459 - DNA, 17 bp, Artificial sequence
  Synthesized sequence
atatcactccggttgct

SEQ ID NO: 2460 - DNA, 17 bp, Artificial sequence
  Synthesized sequence
ctggcgaccagcctgca

SEQ ID NO: 2461 - DNA, 17 bp, Artificial sequence
  Synthesized sequence
ctggcacgggagaagat

SEQ ID NO: 2462 - DNA, 17 bp, Artificial sequence
  Synthesized sequence
ttgacccagcacgtgca

SEQ ID NO: 2463 - DNA, 17 bp, Artificial sequence
  Synthesized sequence
ccgccaaggtcgttgca

SEQ ID NO: 2464 - DNA, 17 bp, Artificial sequence
  Synthesized sequence
ctggtctggtcctcgct

SEQ ID NO: 2465 - DNA, 17 bp, Artificial sequence
  Synthesized sequence
tgggcaccaccatcgcg

SEQ ID NO: 2466 - DNA, 17 bp, Artificial sequence
  Synthesized sequence
cagggccagtccttgca

SEQ ID NO: 2467 - DNA, 17 bp, Artificial sequence
  Synthesized sequence
ctggcgcgcggtcggct

SEQ ID NO: 2468 - DNA, 17 bp, Artificial sequence
  Synthesized sequence
gtcgcatgaagttttca

SEQ ID NO: 2469 - DNA, 17 bp, Artificial sequence
  Synthesized sequence
tcggcaccgccatggcc

SEQ ID NO: 2470 - DNA, 17 bp, Artificial sequence
  Synthesized sequence
atggccgccgccctgct

SEQ ID NO: 2471 - DNA, 17 bp, Artificial sequence
  Synthesized sequence
ctggcctacgccttcca

SEQ ID NO: 2472 - DNA, 17 bp, Artificial sequence
  Synthesized sequence
ctgaccgaggccttgca

SEQ ID NO: 2473 - DNA, 17 bp, Artificial sequence
  Synthesized sequence
tcggcaagaccctggcg

SEQ ID NO: 2474 - DNA, 17 bp, Artificial sequence
  Synthesized sequence
tcggcaagaccctggcg

SEQ ID NO: 2475 - DNA, 17 bp, Artificial sequence
  Synthesized sequence
gcggcggggcagttgcc

SEQ ID NO: 2476 - DNA, 17 bp, Artificial sequence
  Synthesized sequence
gcggcgctgatcgtgct

SEQ ID NO: 2477 - DNA, 17 bp, Artificial sequence
  Synthesized sequence
atggcatgagcggcgcg

SEQ ID NO: 2478 - DNA, 17 bp, Artificial sequence
  Synthesized sequence
ctagcatggacctcgcg

SEQ ID NO: 2479 - DNA, 17 bp, Artificial sequence
  Synthesized sequence
ctagcatggacctcgcg

SEQ ID NO: 2480 - DNA, 17 bp, Artificial sequence
  Synthesized sequence
gtggcgctgctgctgat

SEQ ID NO: 2481 - DNA, 17 bp, Artificial sequence
  Synthesized sequence
gtggcgctgctgctgat

SEQ ID NO: 2482 - DNA, 17 bp, Artificial sequence
  Synthesized sequence
gtggtgcagaaattgtt

SEQ ID NO: 2483 - DNA, 17 bp, Artificial sequence
  Synthesized sequence
ctgggacgctcgaagct

SEQ ID NO: 2484 - DNA, 17 bp, Artificial sequence
  Synthesized sequence
ctgggattgatcgtgcg

SEQ ID NO: 2485 - DNA, 17 bp, Artificial sequence
  Synthesized sequence
ccggcgcggcacctgcc

SEQ ID NO: 2486 - DNA, 17 bp, Artificial sequence
  Synthesized sequence
ctgccgcgcaacctgca

SEQ ID NO: 2487 - DNA, 17 bp, Artificial sequence
  Synthesized sequence
gaggggcgattcttgcg

SEQ ID NO: 2488 - DNA, 17 bp, Artificial sequence
  Synthesized sequence
ccggaacagcgttcgct

SEQ ID NO: 2489 - DNA, 17 bp, Artificial sequence
  Synthesized sequence
ctggcagtgcgccggca

SEQ ID NO: 2490 - DNA, 17 bp, Artificial sequence
  Synthesized sequence
ctgggcctgccgctgct

SEQ ID NO: 2491 - DNA, 17 bp, Artificial sequence
  Synthesized sequence
ctggtagtggcctggct

SEQ ID NO: 2492 - DNA, 17 bp, Artificial sequence
  Synthesized sequence
ctggtatgtccattgag

SEQ ID NO: 2493 - DNA, 17 bp, Artificial sequence
  Synthesized sequence
ttgccgcgacgggtgca

SEQ ID NO: 2494 - DNA, 17 bp, Artificial sequence
  Synthesized sequence
gtggcagagcacccgcg

SEQ ID NO: 2495 - DNA, 17 bp, Artificial sequence
  Synthesized sequence
gtgccacgcctgccgca

SEQ ID NO: 2496 - DNA, 17 bp, Artificial sequence
  Synthesized sequence
atggcgggcatatcgcc

SEQ ID NO: 2497 - DNA, 17 bp, Artificial sequence
  Synthesized sequence
ccggcaggatagctgcg

SEQ ID NO: 2498 - DNA, 17 bp, Artificial sequence
  Synthesized sequence
gaggaacgcgtgttcct

SEQ ID NO: 2499 - DNA, 17 bp, Artificial sequence
  Synthesized sequence
atggcgccggcctggcc

SEQ ID NO: 2500 - DNA, 17 bp, Artificial sequence
  Synthesized sequence
gtggccgagcaactgcg

SEQ ID NO: 2501 - DNA, 17 bp, Artificial sequence
  Synthesized sequence
ctggcaggcctggcgcc

SEQ ID NO: 2502 - DNA, 17 bp, Artificial sequence
  Synthesized sequence
acggcgcggcggtttca

SEQ ID NO: 2503 - DNA, 17 bp, Artificial sequence
  Synthesized sequence
gcggtacgtgctctgca

SEQ ID NO: 2504 - DNA, 17 bp, Artificial sequence
  Synthesized sequence
ttggcaggaactttcat

SEQ ID NO: 2505 - DNA, 17 bp, Artificial sequence
  Synthesized sequence
ctggccttgctgatgcg

SEQ ID NO: 2506 - DNA, 17 bp, Artificial sequence
  Synthesized sequence
ggggtactgctggtgct

SEQ ID NO: 2507 - DNA, 17 bp, Artificial sequence
  Synthesized sequence
ctggcgcgctgcctgga

SEQ ID NO: 2508 - DNA, 17 bp, Artificial sequence
  Synthesized sequence
tggcctcggcgcttgca

SEQ ID NO: 2509 - DNA, 17 bp, Artificial sequence
  Synthesized sequence
ctggcacgattgctaat

SEQ ID NO: 2510 - DNA, 17 bp, Artificial sequence
  Synthesized sequence
gtgtcccaggtgctgct

SEQ ID NO: 2511 - DNA, 17 bp, Artificial sequence
  Synthesized sequence
cagccaggggcattgca

SEQ ID NO: 2512 - DNA, 17 bp, Artificial sequence
  Synthesized sequence
ttcgctcgacgctggct

SEQ ID NO: 2513 - DNA, 17 bp, Artificial sequence
  Synthesized sequence
ttggccacgcctttgat

SEQ ID NO: 2514 - DNA, 17 bp, Artificial sequence
  Synthesized sequence
cccgcccgccagttgct

SEQ ID NO: 2515 - DNA, 17 bp, Artificial sequence
  Synthesized sequence
atggcctgcgcgatgcc

SEQ ID NO: 2516 - DNA, 17 bp, Artificial sequence
  Synthesized sequence
atggtctcgaccttgcg

SEQ ID NO: 2517 - DNA, 17 bp, Artificial sequence
  Synthesized sequence
ctggccacggccctgca

SEQ ID NO: 2518 - DNA, 17 bp, Artificial sequence
  Synthesized sequence
ctggtactgctggtgat

SEQ ID NO: 2519 - DNA, 17 bp, Artificial sequence
  Synthesized sequence
ttggcgccatgggtgcc

SEQ ID NO: 2520 - DNA, 17 bp, Artificial sequence
  Synthesized sequence
ctggcccaaggcgcgct

SEQ ID NO: 2521 - DNA, 17 bp, Artificial sequence
  Synthesized sequence
ccgggacagcgggtgct

SEQ ID NO: 2522 - DNA, 17 bp, Artificial sequence
  Synthesized sequence
taggtacggcccgtgcc

SEQ ID NO: 2523 - DNA, 17 bp, Artificial sequence
  Synthesized sequence
atgtcgcggcgctggca

SEQ ID NO: 2524 - DNA, 17 bp, Artificial sequence
  Synthesized sequence
ctggcccggcacctggg

SEQ ID NO: 2525 - DNA, 17 bp, Artificial sequence
  Synthesized sequence
ttcgccgactacttgct

SEQ ID NO: 2526 - DNA, 17 bp, Artificial sequence
  Synthesized sequence
ctgtcacggaaaaggct

SEQ ID NO: 2527 - DNA, 17 bp, Artificial sequence
  Synthesized sequence
aaggcacgcttgctgga

SEQ ID NO: 2528 - DNA, 17 bp, Artificial sequence
  Synthesized sequence
ctggaagatgaactgct

SEQ ID NO: 2529 - DNA, 17 bp, Artificial sequence
  Synthesized sequence
ctggccacggcgatgct

SEQ ID NO: 2530 - DNA, 17 bp, Artificial sequence
  Synthesized sequence
ctggccacggcgatgct

SEQ ID NO: 2531 - DNA, 17 bp, Artificial sequence
  Synthesized sequence
ctggccctgttcgtgat

SEQ ID NO: 2532 - DNA, 17 bp, Artificial sequence
  Synthesized sequence
gtggccctgctgctggt

SEQ ID NO: 2533 - DNA, 17 bp, Artificial sequence
  Synthesized sequence
ttcgctcgaccctggct

SEQ ID NO: 2534 - DNA, 17 bp, Artificial sequence
  Synthesized sequence
atgccacgcgggtcgcc

SEQ ID NO: 2535 - DNA, 17 bp, Artificial sequence
  Synthesized sequence
gtggcccaggccgcgct

SEQ ID NO: 2536 - DNA, 17 bp, Artificial sequence
  Synthesized sequence
ggggcgcggcacctgcg

SEQ ID NO: 2537 - DNA, 17 bp, Artificial sequence
  Synthesized sequence
ttcggacgtaacctgct

SEQ ID NO: 2538 - DNA, 17 bp, Artificial sequence
  Synthesized sequence
atcgcccgcgccctgct

SEQ ID NO: 2539 - DNA, 17 bp, Artificial sequence
  Synthesized sequence
ctggcagcggtcgcgca

SEQ ID NO: 2540 - DNA, 17 bp, Artificial sequence
  Synthesized sequence
ctgcaactggtattgcc

SEQ ID NO: 2541 - DNA, 17 bp, Artificial sequence
  Synthesized sequence
acggcatccgcgctgct

SEQ ID NO: 2542 - DNA, 17 bp, Artificial sequence
  Synthesized sequence
ctggtgcgggtctggcc

SEQ ID NO: 2543 - DNA, 17 bp, Artificial sequence
  Synthesized sequence
ctggccctgctgctggt

SEQ ID NO: 2544 - DNA, 17 bp, Artificial sequence
  Synthesized sequence
gtggaacgccattcgaa

SEQ ID NO: 2545 - DNA, 17 bp, Artificial sequence
  Synthesized sequence
ctggccgggcgttcgcc

SEQ ID NO: 2546 - DNA, 17 bp, Artificial sequence
  Synthesized sequence
gcggcgcagcctgtgca

SEQ ID NO: 2547 - DNA, 17 bp, Artificial sequence
  Synthesized sequence
ttggaacggcgatggta

SEQ ID NO: 2548 - DNA, 17 bp, Artificial sequence
  Synthesized sequence
ctggcacgccaggcgga

SEQ ID NO: 2549 - DNA, 17 bp, Artificial sequence
  Synthesized sequence
gtgggcctggtggtgct

SEQ ID NO: 2550 - DNA, 17 bp, Artificial sequence
  Synthesized sequence
gtgtcaccgctcttggc

SEQ ID NO: 2551 - DNA, 17 bp, Artificial sequence
  Synthesized sequence
ctggcctgcgactggcc

SEQ ID NO: 2552 - DNA, 17 bp, Artificial sequence
  Synthesized sequence
ctggaaggcgggttgga

SEQ ID NO: 2553 - DNA, 17 bp, Artificial sequence
  Synthesized sequence
ctggcgcaggtcgtcct

SEQ ID NO: 2554 - DNA, 17 bp, Artificial sequence
  Synthesized sequence
gtggccaggccatggcc

SEQ ID NO: 2555 - DNA, 17 bp, Artificial sequence
  Synthesized sequence
atggaattgttttttca

SEQ ID NO: 2556 - DNA, 17 bp, Artificial sequence
  Synthesized sequence
ttggtctgggccatgct

SEQ ID NO: 2557 - DNA, 17 bp, Artificial sequence
  Synthesized sequence
ctgccacggccgccgca

SEQ ID NO: 2558 - DNA, 17 bp, Artificial sequence
  Synthesized sequence
ctggtaccgggttagcc

SEQ ID NO: 2559 - DNA, 17 bp, Artificial sequence
  Synthesized sequence
atggcatggaaggtacg

SEQ ID NO: 2560 - DNA, 17 bp, Artificial sequence
  Synthesized sequence
gcggcgcaaccgctgct

SEQ ID NO: 2561 - DNA, 17 bp, Artificial sequence
  Synthesized sequence
gtggccatggggctgct

SEQ ID NO: 2562 - DNA, 17 bp, Artificial sequence
  Synthesized sequence
ctgggacattcgtcgcc

SEQ ID NO: 2563 - DNA, 17 bp, Artificial sequence
  Synthesized sequence
ttgacattcatactgct

SEQ ID NO: 2564 - DNA, 17 bp, Artificial sequence
  Synthesized sequence
ctggcagcgaccgtggt

SEQ ID NO: 2565 - DNA, 17 bp, Artificial sequence
  Synthesized sequence
gtggcgcgggtattcgt

SEQ ID NO: 2566 - DNA, 17 bp, Artificial sequence
  Synthesized sequence
ctgtgacgaatatcgca

SEQ ID NO: 2567 - DNA, 17 bp, Artificial sequence
  Synthesized sequence
gtggccgggcaatggcc

SEQ ID NO: 2568 - DNA, 17 bp, Artificial sequence
  Synthesized sequence
gtggtgccgaccctgca

SEQ ID NO: 2569 - DNA, 17 bp, Artificial sequence
  Synthesized sequence
ctggcgcagaccaagca

SEQ ID NO: 2570 - DNA, 17 bp, Artificial sequence
  Synthesized sequence
ccggcaccgcctttgtc

SEQ ID NO: 2571 - DNA, 17 bp, Artificial sequence
  Synthesized sequence
gtggcgcggctctcggg

SEQ ID NO: 2572 - DNA, 17 bp, Artificial sequence
  Synthesized sequence
atggcgcgcgaagtggt

SEQ ID NO: 2573 - DNA, 17 bp, Artificial sequence
  Synthesized sequence
ctggcagggcaagggcg

SEQ ID NO: 2574 - DNA, 17 bp, Artificial sequence
  Synthesized sequence
gaggcccgacgcctgcg

SEQ ID NO: 2575 - DNA, 17 bp, Artificial sequence
  Synthesized sequence
gcggcaaggctattacg

SEQ ID NO: 2576 - DNA, 17 bp, Artificial sequence
  Synthesized sequence
ccggcgcgcaaattgtt

SEQ ID NO: 2577 - DNA, 17 bp, Artificial sequence
  Synthesized sequence
gcggcccaggcctcgct

SEQ ID NO: 2578 - DNA, 17 bp, Artificial sequence
  Synthesized sequence
ctcgcaggtttcttgtt

SEQ ID NO: 2579 - DNA, 17 bp, Artificial sequence
  Synthesized sequence
caggtgcggcagttgcg

SEQ ID NO: 2580 - DNA, 17 bp, Artificial sequence
  Synthesized sequence
gtggaacaaccacggct

SEQ ID NO: 2581 - DNA, 17 bp, Artificial sequence
  Synthesized sequence
ctgggcctggtagtgct

SEQ ID NO: 2582 - DNA, 17 bp, Artificial sequence
  Synthesized sequence
tcggcgcggatctcgcg

SEQ ID NO: 2583 - DNA, 17 bp, Artificial sequence
  Synthesized sequence
caggcccggctctggcc

SEQ ID NO: 2584 - DNA, 17 bp, Artificial sequence
  Synthesized sequence
gtggtcggcctgctgct

SEQ ID NO: 2585 - DNA, 17 bp, Artificial sequence
  Synthesized sequence
ttcgcccagcgcctgct

SEQ ID NO: 2586 - DNA, 17 bp, Artificial sequence
  Synthesized sequence
gtggttccgagcctgct

SEQ ID NO: 2587 - DNA, 17 bp, Artificial sequence
  Synthesized sequence
ggggcgccgctgctgct

SEQ ID NO: 2588 - DNA, 17 bp, Artificial sequence
  Synthesized sequence
cgggctggcgggttgca

SEQ ID NO: 2589 - DNA, 17 bp, Artificial sequence
  Synthesized sequence
ctggccgtggctctgca

SEQ ID NO: 2590 - DNA, 17 bp, Artificial sequence
  Synthesized sequence
tcggcctgggcgttgcc

SEQ ID NO: 2591 - DNA, 17 bp, Artificial sequence
  Synthesized sequence
gttgccctgcgattgcg

SEQ ID NO: 2592 - DNA, 17 bp, Artificial sequence
  Synthesized sequence
ctggccctggtcctgat

SEQ ID NO: 2593 - DNA, 17 bp, Artificial sequence
  Synthesized sequence
gtggccgatgaagtgct

SEQ ID NO: 2594 - DNA, 17 bp, Artificial sequence
  Synthesized sequence
ggggcatgcaactggcg

SEQ ID NO: 2595 - DNA, 17 bp, Artificial sequence
  Synthesized sequence
ctggcgcatctgcagct

SEQ ID NO: 2596 - DNA, 17 bp, Artificial sequence
  Synthesized sequence
ctggcagcgtcccggct

SEQ ID NO: 2597 - DNA, 17 bp, Artificial sequence
  Synthesized sequence
atggcaccaacggcgcc

SEQ ID NO: 2598 - DNA, 17 bp, Artificial sequence
  Synthesized sequence
tggggagggttgttgcc

SEQ ID NO: 2599 - DNA, 17 bp, Artificial sequence
  Synthesized sequence
atggccgatcagttgat

SEQ ID NO: 2600 - DNA, 17 bp, Artificial sequence
  Synthesized sequence
caggcgcagcagatgca

SEQ ID NO: 2601 - DNA, 17 bp, Artificial sequence
  Synthesized sequence
ttgccagacctatggct

SEQ ID NO: 2602 - DNA, 17 bp, Artificial sequence
  Synthesized sequence
atggcaaggacaccgcc

SEQ ID NO: 2603 - DNA, 17 bp, Artificial sequence
  Synthesized sequence
ctgccgctggtattgcc

SEQ ID NO: 2604 - DNA, 17 bp, Artificial sequence
  Synthesized sequence
caggatcgcggcttgca

SEQ ID NO: 2605 - DNA, 17 bp, Artificial sequence
  Synthesized sequence
gtggtgcgggccctgcg

SEQ ID NO: 2606 - DNA, 17 bp, Artificial sequence
  Synthesized sequence
caggaataccccttgcg

SEQ ID NO: 2607 - DNA, 17 bp, Artificial sequence
  Synthesized sequence
gtgacagggagtttgat

SEQ ID NO: 2608 - DNA, 17 bp, Artificial sequence
  Synthesized sequence
tcggcaaggccctggcc

SEQ ID NO: 2609 - DNA, 17 bp, Artificial sequence
  Synthesized sequence
gcggccgcgagcttgct

SEQ ID NO: 2610 - DNA, 17 bp, Artificial sequence
  Synthesized sequence
ctggcgcaggtcatcca

SEQ ID NO: 2611 - DNA, 17 bp, Artificial sequence
  Synthesized sequence
ctggcgcaggtcatcca

SEQ ID NO: 2612 - DNA, 17 bp, Artificial sequence
  Synthesized sequence
cgtgcgcggcagttgca

SEQ ID NO: 2613 - DNA, 17 bp, Artificial sequence
  Synthesized sequence
ctggcggaactgctgcc

SEQ ID NO: 2614 - DNA, 17 bp, Artificial sequence
  Synthesized sequence
ctggcgcgcgccctgga

SEQ ID NO: 2615 - DNA, 17 bp, Artificial sequence
  Synthesized sequence
gtgggcgtggccttgca

SEQ ID NO: 2616 - DNA, 17 bp, Artificial sequence
  Synthesized sequence
ttggaaggcctgtagcg

SEQ ID NO: 2617 - DNA, 17 bp, Artificial sequence
  Synthesized sequence
gtcgcacgcagtttccg

SEQ ID NO: 2618 - DNA, 17 bp, Artificial sequence
  Synthesized sequence
ctggcaccgtcacggcc

SEQ ID NO: 2619 - DNA, 17 bp, Artificial sequence
  Synthesized sequence
caggaaagccagttgcg

SEQ ID NO: 2620 - DNA, 17 bp, Artificial sequence
  Synthesized sequence
ccggaacaaccggtgca

SEQ ID NO: 2621 - DNA, 17 bp, Artificial sequence
  Synthesized sequence
gaggtgcaggcgttgct

SEQ ID NO: 2622 - DNA, 17 bp, Artificial sequence
  Synthesized sequence
gtggcccgcggcaagca

SEQ ID NO: 2623 - DNA, 17 bp, Artificial sequence
  Synthesized sequence
gtggcccgcggcaagca

SEQ ID NO: 2624 - DNA, 17 bp, Artificial sequence
  Synthesized sequence
cggccacggcgagtgct

SEQ ID NO: 2625 - DNA, 17 bp, Artificial sequence
  Synthesized sequence
atggaacggctacagcg

SEQ ID NO: 2626 - DNA, 17 bp, Artificial sequence
  Synthesized sequence
gtggaacggcgcttcaa

SEQ ID NO: 2627 - DNA, 17 bp, Artificial sequence
  Synthesized sequence
ctggccccgcttgagct

SEQ ID NO: 2628 - DNA, 17 bp, Artificial sequence
  Synthesized sequence
ttggcatgggctgttcg

SEQ ID NO: 2629 - DNA, 17 bp, Artificial sequence
  Synthesized sequence
ctggcgctactcctggt

SEQ ID NO: 2630 - DNA, 17 bp, Artificial sequence
  Synthesized sequence
ctggcgagacgcttgag

SEQ ID NO: 2631 - DNA, 17 bp, Artificial sequence
  Synthesized sequence
gtggtctctggcttgct

SEQ ID NO: 2632 - DNA, 17 bp, Artificial sequence
  Synthesized sequence
atggcgcgcgcagtgat

SEQ ID NO: 2633 - DNA, 17 bp, Artificial sequence
  Synthesized sequence
ttggcacgacgggcggt

SEQ ID NO: 2634 - DNA, 17 bp, Artificial sequence
  Synthesized sequence
ggtgcacgtggcttgcg

SEQ ID NO: 2635 - DNA, 17 bp, Artificial sequence
  Synthesized sequence
cgggcacgtattccgca

SEQ ID NO: 2636 - DNA, 17 bp, Artificial sequence
  Synthesized sequence
ctggcagtactacagca

SEQ ID NO: 2637 - DNA, 17 bp, Artificial sequence
  Synthesized sequence
ttcgcccagttcgtgca

SEQ ID NO: 2638 - DNA, 17 bp, Artificial sequence
  Synthesized sequence
atggccggcaagctgcg

SEQ ID NO: 2639 - DNA, 17 bp, Artificial sequence
  Synthesized sequence
gtcgctcgccggatgct

SEQ ID NO: 2640 - DNA, 17 bp, Artificial sequence
  Synthesized sequence
agggcatgcggcgtgcc

SEQ ID NO: 2641 - DNA, 17 bp, Artificial sequence
  Synthesized sequence
gtggaacatgggtggcg

SEQ ID NO: 2642 - DNA, 17 bp, Artificial sequence
  Synthesized sequence
atgacgctttgattgca

SEQ ID NO: 2643 - DNA, 17 bp, Artificial sequence
  Synthesized sequence
atggctaaatggctgca

SEQ ID NO: 2644 - DNA, 17 bp, Artificial sequence
  Synthesized sequence
ccggcacgcgccgcgca

SEQ ID NO: 2645 - DNA, 17 bp, Artificial sequence
  Synthesized sequence
ctggccgccgccgtgct

SEQ ID NO: 2646 - DNA, 17 bp, Artificial sequence
  Synthesized sequence
ttggccgcgctgttcca

SEQ ID NO: 2647 - DNA, 17 bp, Artificial sequence
  Synthesized sequence
atggaatgcctggcgct

SEQ ID NO: 2648 - DNA, 17 bp, Artificial sequence
  Synthesized sequence
atggcagggctttcccg

SEQ ID NO: 2649 - DNA, 17 bp, Artificial sequence
  Synthesized sequence
ctgcaacgccagtcgct

SEQ ID NO: 2650 - DNA, 17 bp, Artificial sequence
  Synthesized sequence
ctggttcgtgtcttgga

SEQ ID NO: 2651 - DNA, 17 bp, Artificial sequence
  Synthesized sequence
ttggcacagcttagcct

SEQ ID NO: 2652 - DNA, 17 bp, Artificial sequence
  Synthesized sequence
atgtcacgcatggcgct

SEQ ID NO: 2653 - DNA, 17 bp, Artificial sequence
  Synthesized sequence
gtgggacgcacgctcct

SEQ ID NO: 2654 - DNA, 17 bp, Artificial sequence
  Synthesized sequence
ctggaagagcatctgcg

SEQ ID NO: 2655 - DNA, 17 bp, Artificial sequence
  Synthesized sequence
ctggcagacgctgggct

SEQ ID NO: 2656 - DNA, 17 bp, Artificial sequence
  Synthesized sequence
gcggtgcaggcgttgct

SEQ ID NO: 2657 - DNA, 17 bp, Artificial sequence
  Synthesized sequence
ctggcacggcccctcga

SEQ ID NO: 2658 - DNA, 17 bp, Artificial sequence
  Synthesized sequence
gtggcgaataccgtgca

SEQ ID NO: 2659 - DNA, 17 bp, Artificial sequence
  Synthesized sequence
ctggccatggaactgca

SEQ ID NO: 2660 - DNA, 17 bp, Artificial sequence
  Synthesized sequence
ctgtcgcgggcctggct

SEQ ID NO: 2661 - DNA, 17 bp, Artificial sequence
  Synthesized sequence
gcgctacgccggttgct

SEQ ID NO: 2662 - DNA, 17 bp, Artificial sequence
  Synthesized sequence
ctggcgcaacggacgct

SEQ ID NO: 2663 - DNA, 17 bp, Artificial sequence
  Synthesized sequence
ctggcattggaactggt

SEQ ID NO: 2664 - DNA, 17 bp, Artificial sequence
  Synthesized sequence
tgcgcactctcgttgca

SEQ ID NO: 2665 - DNA, 17 bp, Artificial sequence
  Synthesized sequence
ccggaacgctgctggct

SEQ ID NO: 2666 - DNA, 17 bp, Artificial sequence
  Synthesized sequence
atggcgtgcgcatcgcg

SEQ ID NO: 2667 - DNA, 17 bp, Artificial sequence
  Synthesized sequence
ctggcacggtcggcgaa

SEQ ID NO: 2668 - DNA, 17 bp, Artificial sequence
  Synthesized sequence
ctggctggagcgtttca

SEQ ID NO: 2669 - DNA, 17 bp, Artificial sequence
  Synthesized sequence
ctggggcgacacctgcc

SEQ ID NO: 2670 - DNA, 17 bp, Artificial sequence
  Synthesized sequence
ctggggcgacacctgcc

SEQ ID NO: 2671 - DNA, 17 bp, Artificial sequence
  Synthesized sequence
atggctttcgatatgca

SEQ ID NO: 2672 - DNA, 17 bp, Artificial sequence
  Synthesized sequence
caggcacaggcgttccg

SEQ ID NO: 2673 - DNA, 17 bp, Artificial sequence
  Synthesized sequence
atggccagcccgtcgcg

SEQ ID NO: 2674 - DNA, 17 bp, Artificial sequence
  Synthesized sequence
ctggaaacagccatgca

SEQ ID NO: 2675 - DNA, 17 bp, Artificial sequence
  Synthesized sequence
atggcgctctggctgcg

SEQ ID NO: 2676 - DNA, 17 bp, Artificial sequence
  Synthesized sequence
aaggcaccaccttcgcc

SEQ ID NO: 2677 - DNA, 17 bp, Artificial sequence
  Synthesized sequence
cgggcccggggcttcct

SEQ ID NO: 2678 - DNA, 17 bp, Artificial sequence
  Synthesized sequence
ctggaacgcgccgttct

SEQ ID NO: 2679 - DNA, 17 bp, Artificial sequence
  Synthesized sequence
ctggcaggaagccggcg

SEQ ID NO: 2680 - DNA, 17 bp, Artificial sequence
  Synthesized sequence
gtagcacggcgaccgct

SEQ ID NO: 2681 - DNA, 17 bp, Artificial sequence
  Synthesized sequence
gtggcccggcaccagcg

SEQ ID NO: 2682 - DNA, 17 bp, Artificial sequence
  Synthesized sequence
ctggcacgcatcgaaca

SEQ ID NO: 2683 - DNA, 17 bp, Artificial sequence
  Synthesized sequence
ctggcgctggacttccc

SEQ ID NO: 2684 - DNA, 17 bp, Artificial sequence
  Synthesized sequence
gtggccgagcgcctgcg

SEQ ID NO: 2685 - DNA, 17 bp, Artificial sequence
  Synthesized sequence
ttcgaacggccgttggt

SEQ ID NO: 2686 - DNA, 17 bp, Artificial sequence
  Synthesized sequence
ctggcgcccgatgtgcc

SEQ ID NO: 2687 - DNA, 17 bp, Artificial sequence
  Synthesized sequence
gcggcgcgccgattggt

SEQ ID NO: 2688 - DNA, 17 bp, Artificial sequence
  Synthesized sequence
gcggcgcgccgattggt

SEQ ID NO: 2689 - DNA, 17 bp, Artificial sequence
  Synthesized sequence
caggcacgacgagcgca

SEQ ID NO: 2690 - DNA, 17 bp, Artificial sequence
  Synthesized sequence
gtgggacgtccggtggt

SEQ ID NO: 2691 - DNA, 17 bp, Artificial sequence
  Synthesized sequence
gaggccgcacagttgct

SEQ ID NO: 2692 - DNA, 17 bp, Artificial sequence
  Synthesized sequence
ctggcgcactatccgct

SEQ ID NO: 2693 - DNA, 17 bp, Artificial sequence
  Synthesized sequence
ctggcgcaacgcccgca

SEQ ID NO: 2694 - DNA, 17 bp, Artificial sequence
  Synthesized sequence
ctggcgatccgcctgca

SEQ ID NO: 2695 - DNA, 17 bp, Artificial sequence
  Synthesized sequence
gtggcgaggagctggcg

SEQ ID NO: 2696 - DNA, 17 bp, Artificial sequence
  Synthesized sequence
ctggcgcaacctgcgca

SEQ ID NO: 2697 - DNA, 17 bp, Artificial sequence
  Synthesized sequence
ttggccctggggtcgcc

SEQ ID NO: 2698 - DNA, 17 bp, Artificial sequence
  Synthesized sequence
gtggcctggcgcaggct

SEQ ID NO: 2699 - DNA, 17 bp, Artificial sequence
  Synthesized sequence
atggaacgatcctggga

SEQ ID NO: 2700 - DNA, 17 bp, Artificial sequence
  Synthesized sequence
ctggcggcgctgttcca

SEQ ID NO: 2701 - DNA, 17 bp, Artificial sequence
  Synthesized sequence
ctggcccagggcctggt

SEQ ID NO: 2702 - DNA, 17 bp, Artificial sequence
  Synthesized sequence
gtggcgcatggctagcc

SEQ ID NO: 2703 - DNA, 17 bp, Artificial sequence
  Synthesized sequence
gtggaacgatgagtggt

SEQ ID NO: 2704 - DNA, 17 bp, Artificial sequence
  Synthesized sequence
tttggaaaacgcttgca

SEQ ID NO: 2705 - DNA, 17 bp, Artificial sequence
  Synthesized sequence
gcggtactgatcctgca

SEQ ID NO: 2706 - DNA, 17 bp, Artificial sequence
  Synthesized sequence
ctcgaacaactgatgca

SEQ ID NO: 2707 - DNA, 17 bp, Artificial sequence
  Synthesized sequence
ccggctcggcacctgcg

SEQ ID NO: 2708 - DNA, 17 bp, Artificial sequence
  Synthesized sequence
ctggcgttctggctgct

SEQ ID NO: 2709 - DNA, 17 bp, Artificial sequence
  Synthesized sequence
gtggcgcagttcgtcca

SEQ ID NO: 2710 - DNA, 17 bp, Artificial sequence
  Synthesized sequence
ctggcgcgactcatggc

SEQ ID NO: 2711 - DNA, 17 bp, Artificial sequence
  Synthesized sequence
gtgggagtgtgcatgct

SEQ ID NO: 2712 - DNA, 17 bp, Artificial sequence
  Synthesized sequence
gtggcaatccggttgtc

SEQ ID NO: 2713 - DNA, 17 bp, Artificial sequence
  Synthesized sequence
atggcccagcgcctcca

SEQ ID NO: 2714 - DNA, 17 bp, Artificial sequence
  Synthesized sequence
tcggcatggagatcgcc

SEQ ID NO: 2715 - DNA, 17 bp, Artificial sequence
  Synthesized sequence
atgccgcgcaccctgca

SEQ ID NO: 2716 - DNA, 17 bp, Artificial sequence
  Synthesized sequence
gcggcaccggcctggcg

SEQ ID NO: 2717 - DNA, 17 bp, Artificial sequence
  Synthesized sequence
ctggtacggcaaccgcg

SEQ ID NO: 2718 - DNA, 17 bp, Artificial sequence
  Synthesized sequence
ctggtgctgccggtgct

SEQ ID NO: 2719 - DNA, 17 bp, Artificial sequence
  Synthesized sequence
gcggcgcccggcttgcc

SEQ ID NO: 2720 - DNA, 17 bp, Artificial sequence
  Synthesized sequence
ctggtgccggtctggct

SEQ ID NO: 2721 - DNA, 17 bp, Artificial sequence
  Synthesized sequence
ctggcgatcgccctgct

SEQ ID NO: 2722 - DNA, 17 bp, Artificial sequence
  Synthesized sequence
gtggtgctggtggtgct

SEQ ID NO: 2723 - DNA, 17 bp, Artificial sequence
  Synthesized sequence
gcggcacggctaccgcg

SEQ ID NO: 2724 - DNA, 17 bp, Artificial sequence
  Synthesized sequence
ccggcgcgctggatgca

SEQ ID NO: 2725 - DNA, 17 bp, Artificial sequence
  Synthesized sequence
ctggcatggatgttctg

SEQ ID NO: 2726 - DNA, 17 bp, Artificial sequence
  Synthesized sequence
ctgacaacaggcttgcc

SEQ ID NO: 2727 - DNA, 17 bp, Artificial sequence
  Synthesized sequence
cgggcaggcctgtcgcg

SEQ ID NO: 2728 - DNA, 17 bp, Artificial sequence
  Synthesized sequence
gcgggaatgcagttgct

SEQ ID NO: 2729 - DNA, 17 bp, Artificial sequence
  Synthesized sequence
tttgccggccttttgcg

SEQ ID NO: 2730 - DNA, 17 bp, Artificial sequence
  Synthesized sequence
ctggcttgagattggcg

SEQ ID NO: 2731 - DNA, 17 bp, Artificial sequence
  Synthesized sequence
ctggtccgccatctgcg

SEQ ID NO: 2732 - DNA, 17 bp, Artificial sequence
  Synthesized sequence
tcggcgcggctctggcg

SEQ ID NO: 2733 - DNA, 17 bp, Artificial sequence
  Synthesized sequence
ctggccagcaagctgcc

SEQ ID NO: 2734 - DNA, 17 bp, Artificial sequence
  Synthesized sequence
gtgggtcagtcggtgct

SEQ ID NO: 2735 - DNA, 17 bp, Artificial sequence
  Synthesized sequence
ttggcaccgacagtgtc

SEQ ID NO: 2736 - DNA, 17 bp, Artificial sequence
  Synthesized sequence
ctggaaccgaccttacc

SEQ ID NO: 2737 - DNA, 17 bp, Artificial sequence
  Synthesized sequence
tcggcgtgcaggttgcc

SEQ ID NO: 2738 - DNA, 17 bp, Artificial sequence
  Synthesized sequence
ggggcccggttgctgcg

SEQ ID NO: 2739 - DNA, 17 bp, Artificial sequence
  Synthesized sequence
caggcccaggatgtgct

SEQ ID NO: 2740 - DNA, 17 bp, Artificial sequence
  Synthesized sequence
gtggctgccgacctgct

SEQ ID NO: 2741 - DNA, 17 bp, Artificial sequence
  Synthesized sequence
ttgccccgcgccgtgct

SEQ ID NO: 2742 - DNA, 17 bp, Artificial sequence
  Synthesized sequence
gagtcatgactgttgcc

SEQ ID NO: 2743 - DNA, 17 bp, Artificial sequence
  Synthesized sequence
gaggaacatcccatgct

SEQ ID NO: 2744 - DNA, 17 bp, Artificial sequence
  Synthesized sequence
gaggaacatcccatgct

SEQ ID NO: 2745 - DNA, 17 bp, Artificial sequence
  Synthesized sequence
atcgcacccttcatgcc

SEQ ID NO: 2746 - DNA, 17 bp, Artificial sequence
  Synthesized sequence
ccggcgcgctcctggca

SEQ ID NO: 2747 - DNA, 17 bp, Artificial sequence
  Synthesized sequence
ctggcaaatcgcatgat

SEQ ID NO: 2748 - DNA, 17 bp, Artificial sequence
  Synthesized sequence
gtgctacgccaattgat

SEQ ID NO: 2749 - DNA, 17 bp, Artificial sequence
  Synthesized sequence
ctggcacaagcagtacc

SEQ ID NO: 2750 - DNA, 17 bp, Artificial sequence
  Synthesized sequence
ctgtcaagaaaattgat

SEQ ID NO: 2751 - DNA, 17 bp, Artificial sequence
  Synthesized sequence
atggtctgcgacctgct

SEQ ID NO: 2752 - DNA, 17 bp, Artificial sequence
  Synthesized sequence
caggccgatatgttgca

SEQ ID NO: 2753 - DNA, 17 bp, Artificial sequence
  Synthesized sequence
gcgacacggcggatgct

SEQ ID NO: 2754 - DNA, 17 bp, Artificial sequence
  Synthesized sequence
ctggcaggccctcggcg

SEQ ID NO: 2755 - DNA, 17 bp, Artificial sequence
  Synthesized sequence
atgggccgtgtgtagca

SEQ ID NO: 2756 - DNA, 17 bp, Artificial sequence
  Synthesized sequence
caggcgcaggccctgca

SEQ ID NO: 2757 - DNA, 17 bp, Artificial sequence
  Synthesized sequence
ctcgcacccggctagca

SEQ ID NO: 2758 - DNA, 17 bp, Artificial sequence
  Synthesized sequence
gaggcccgtgcgctgct

SEQ ID NO: 2759 - DNA, 17 bp, Artificial sequence
  Synthesized sequence
ttggaacgcagggtgaa

SEQ ID NO: 2760 - DNA, 17 bp, Artificial sequence
  Synthesized sequence
gtggtccaggcctggca

SEQ ID NO: 2761 - DNA, 17 bp, Artificial sequence
  Synthesized sequence
ctggcacatctatagac

SEQ ID NO: 2762 - DNA, 17 bp, Artificial sequence
  Synthesized sequence
gaggcgcgcaatttact

SEQ ID NO: 2763 - DNA, 17 bp, Artificial sequence
  Synthesized sequence
atcccccgcctcttgca

SEQ ID NO: 2764 - DNA, 17 bp, Artificial sequence
  Synthesized sequence
gtggcgcgtcagctgga

SEQ ID NO: 2765 - DNA, 17 bp, Artificial sequence
  Synthesized sequence
gtggcaagcgcatccct

SEQ ID NO: 2766 - DNA, 17 bp, Artificial sequence
  Synthesized sequence
ctggcaaggcgtgcgcc

SEQ ID NO: 2767 - DNA, 17 bp, Artificial sequence
  Synthesized sequence
ctgggacgggcgctgga

SEQ ID NO: 2768 - DNA, 17 bp, Artificial sequence
  Synthesized sequence
ctggctcgcgcgctggt

SEQ ID NO: 2769 - DNA, 17 bp, Artificial sequence
  Synthesized sequence
caggaaccgcgcctgct

SEQ ID NO: 2770 - DNA, 17 bp, Artificial sequence
  Synthesized sequence
ctggcattgctgttctt

SEQ ID NO: 2771 - DNA, 17 bp, Artificial sequence
  Synthesized sequence
gcggaacagcccttcct

SEQ ID NO: 2772 - DNA, 17 bp, Artificial sequence
  Synthesized sequence
gtggccctgctgctgat

SEQ ID NO: 2773 - DNA, 17 bp, Artificial sequence
  Synthesized sequence
ctggtcggcctgctgct

SEQ ID NO: 2774 - DNA, 17 bp, Artificial sequence
  Synthesized sequence
tcgtcacaaggcttgcg

SEQ ID NO: 2775 - DNA, 17 bp, Artificial sequence
  Synthesized sequence
ttggacctgcccatgca

SEQ ID NO: 2776 - DNA, 17 bp, Artificial sequence
  Synthesized sequence
cgggcaaggcgctcgcg

SEQ ID NO: 2777 - DNA, 17 bp, Artificial sequence
  Synthesized sequence
gtgccgttgccattgct

SEQ ID NO: 2778 - DNA, 17 bp, Artificial sequence
  Synthesized sequence
atcgctggtcagttgct

SEQ ID NO: 2779 - DNA, 17 bp, Artificial sequence
  Synthesized sequence
aaggcatgatgctggcg

SEQ ID NO: 2780 - DNA, 17 bp, Artificial sequence
  Synthesized sequence
ctggccttcgtgttgtt

SEQ ID NO: 2781 - DNA, 17 bp, Artificial sequence
  Synthesized sequence
ctggtactgatcaagct

SEQ ID NO: 2782 - DNA, 17 bp, Artificial sequence
  Synthesized sequence
ctggcccggggtattct

SEQ ID NO: 2783 - DNA, 17 bp, Artificial sequence
  Synthesized sequence
ctggcggtggaggtgct

SEQ ID NO: 2784 - DNA, 17 bp, Artificial sequence
  Synthesized sequence
ctggccgctcgcgtgct

SEQ ID NO: 2785 - DNA, 17 bp, Artificial sequence
  Synthesized sequence
atcgaccgcgccttgct

SEQ ID NO: 2786 - DNA, 17 bp, Artificial sequence
  Synthesized sequence
gaggctcggcgtttcct

SEQ ID NO: 2787 - DNA, 17 bp, Artificial sequence
  Synthesized sequence
tcggcagacgtttcgca

SEQ ID NO: 2788 - DNA, 17 bp, Artificial sequence
  Synthesized sequence
ttcgccctgctcctgct

SEQ ID NO: 2789 - DNA, 17 bp, Artificial sequence
  Synthesized sequence
ctggcgaagctttcgcc

SEQ ID NO: 2790 - DNA, 17 bp, Artificial sequence
  Synthesized sequence
gcggaacgtgccatgca

SEQ ID NO: 2791 - DNA, 17 bp, Artificial sequence
  Synthesized sequence
ccggagtgcctgttgct

SEQ ID NO: 2792 - DNA, 17 bp, Artificial sequence
  Synthesized sequence
ctggcgcgcggcgcgca

SEQ ID NO: 2793 - DNA, 17 bp, Artificial sequence
  Synthesized sequence
gaggaacacaacatgca

SEQ ID NO: 2794 - DNA, 17 bp, Artificial sequence
  Synthesized sequence
ctgacacgcctggcgca

SEQ ID NO: 2795 - DNA, 17 bp, Artificial sequence
  Synthesized sequence
ctggaacgcggagggct

SEQ ID NO: 2796 - DNA, 17 bp, Artificial sequence
  Synthesized sequence
ctggtggagcagttgcg

SEQ ID NO: 2797 - DNA, 17 bp, Artificial sequence
  Synthesized sequence
gtggaagacctgctgcg

SEQ ID NO: 2798 - DNA, 17 bp, Artificial sequence
  Synthesized sequence
cttgctcgggcactgct

SEQ ID NO: 2799 - DNA, 17 bp, Artificial sequence
  Synthesized sequence
ctgccgtggccattgcg

SEQ ID NO: 2800 - DNA, 17 bp, Artificial sequence
  Synthesized sequence
ctggtccaggcctggca

SEQ ID NO: 2801 - DNA, 17 bp, Artificial sequence
  Synthesized sequence
atggcgcggcgccggcg

SEQ ID NO: 2802 - DNA, 17 bp, Artificial sequence
  Synthesized sequence
ttggcgggacactggcc

SEQ ID NO: 2803 - DNA, 17 bp, Artificial sequence
  Synthesized sequence
gaggaattcgccttgct

SEQ ID NO: 2804 - DNA, 17 bp, Artificial sequence
  Synthesized sequence
agggaaaaagcgttgct

SEQ ID NO: 2805 - DNA, 17 bp, Artificial sequence
  Synthesized sequence
gtagcgtgggccttgcc

SEQ ID NO: 2806 - DNA, 17 bp, Artificial sequence
  Synthesized sequence
atggcacgttggtgtcg

SEQ ID NO: 2807 - DNA, 17 bp, Artificial sequence
  Synthesized sequence
tcggtatcctggttgct

SEQ ID NO: 2808 - DNA, 17 bp, Artificial sequence
  Synthesized sequence
tcggtatcctggttgct

SEQ ID NO: 2809 - DNA, 17 bp, Artificial sequence
  Synthesized sequence
atggcgaggatgtttcc

SEQ ID NO: 2810 - DNA, 17 bp, Artificial sequence
  Synthesized sequence
gtggtgctacccctgca

SEQ ID NO: 2811 - DNA, 17 bp, Artificial sequence
  Synthesized sequence
ttggcgctgctcgggca

SEQ ID NO: 2812 - DNA, 17 bp, Artificial sequence
  Synthesized sequence
atggccagctccgtgcc

SEQ ID NO: 2813 - DNA, 17 bp, Artificial sequence
  Synthesized sequence
ctggcgcagccgctgtt

SEQ ID NO: 2814 - DNA, 17 bp, Artificial sequence
  Synthesized sequence
gtcgcggtgctgttgct

SEQ ID NO: 2815 - DNA, 17 bp, Artificial sequence
  Synthesized sequence
ctgccgcgcgccgtgct

SEQ ID NO: 2816 - DNA, 17 bp, Artificial sequence
  Synthesized sequence
caggcgcaggcgctgct

SEQ ID NO: 2817 - DNA, 17 bp, Artificial sequence
  Synthesized sequence
ctggagcacttcttcct

SEQ ID NO: 2818 - DNA, 17 bp, Artificial sequence
  Synthesized sequence
ccggcgccgttcatgca

SEQ ID NO: 2819 - DNA, 17 bp, Artificial sequence
  Synthesized sequence
tgggcatgtaccgtgcg

SEQ ID NO: 2820 - DNA, 17 bp, Artificial sequence
  Synthesized sequence
atgccactcagattgaa

SEQ ID NO: 2821 - DNA, 17 bp, Artificial sequence
  Synthesized sequence
aaggcatcggtgtagct

SEQ ID NO: 2822 - DNA, 17 bp, Artificial sequence
  Synthesized sequence
ctggcggtgctcttcca

SEQ ID NO: 2823 - DNA, 17 bp, Artificial sequence
  Synthesized sequence
tcggtgccgcgcttgct

SEQ ID NO: 2824 - DNA, 17 bp, Artificial sequence
  Synthesized sequence
ctggaaacccagatgca

SEQ ID NO: 2825 - DNA, 17 bp, Artificial sequence
  Synthesized sequence
ttcgctccgccgttgcg

SEQ ID NO: 2826 - DNA, 17 bp, Artificial sequence
  Synthesized sequence
ccggctcgtccgatgct

SEQ ID NO: 2827 - DNA, 17 bp, Artificial sequence
  Synthesized sequence
ctgccgcggcagtggca

SEQ ID NO: 2828 - DNA, 17 bp, Artificial sequence
  Synthesized sequence
ctggtccaccaatggct

SEQ ID NO: 2829 - DNA, 17 bp, Artificial sequence
  Synthesized sequence
ctggcccaggagctgat

SEQ ID NO: 2830 - DNA, 17 bp, Artificial sequence
  Synthesized sequence
ccggcatgccgctggcg

SEQ ID NO: 2831 - DNA, 17 bp, Artificial sequence
  Synthesized sequence
tgggcgcggaatttcca

SEQ ID NO: 2832 - DNA, 17 bp, Artificial sequence
  Synthesized sequence
ggggggctgctgttgct

SEQ ID NO: 2833 - DNA, 17 bp, Artificial sequence
  Synthesized sequence
gtggtacaggacgtcct

SEQ ID NO: 2834 - DNA, 17 bp, Artificial sequence
  Synthesized sequence
gtggcgcgcgcgacgca

SEQ ID NO: 2835 - DNA, 17 bp, Artificial sequence
  Synthesized sequence
ctggtctgcctctggca

SEQ ID NO: 2836 - DNA, 17 bp, Artificial sequence
  Synthesized sequence
cgggcatgttcgttcct

SEQ ID NO: 2837 - DNA, 17 bp, Artificial sequence
  Synthesized sequence
cgggcactgcgctggcc

SEQ ID NO: 2838 - DNA, 17 bp, Artificial sequence
  Synthesized sequence
cgggcatcatcggtgct

SEQ ID NO: 2839 - DNA, 17 bp, Artificial sequence
  Synthesized sequence
gtggccctgttcgagct

SEQ ID NO: 2840 - DNA, 17 bp, Artificial sequence
  Synthesized sequence
ggagcagagtttttgct

SEQ ID NO: 2841 - DNA, 17 bp, Artificial sequence
  Synthesized sequence
atagcaaaaactctgct

SEQ ID NO: 2842 - DNA, 17 bp, Artificial sequence
  Synthesized sequence
caggcgcgcggactgct

SEQ ID NO: 2843 - DNA, 17 bp, Artificial sequence
  Synthesized sequence
ttggcagggaagcggcg

SEQ ID NO: 2844 - DNA, 17 bp, Artificial sequence
  Synthesized sequence
gtcggacagcgcctgct

SEQ ID NO: 2845 - DNA, 17 bp, Artificial sequence
  Synthesized sequence
ctggcggaacagtttca

SEQ ID NO: 2846 - DNA, 17 bp, Artificial sequence
  Synthesized sequence
ctggcgcgcgaactgtt

SEQ ID NO: 2847 - DNA, 17 bp, Artificial sequence
  Synthesized sequence
cctgtacgacatttgca

SEQ ID NO: 2848 - DNA, 17 bp, Artificial sequence
  Synthesized sequence
ctggtactactgcagct

SEQ ID NO: 2849 - DNA, 17 bp, Artificial sequence
  Synthesized sequence
cgggatcgtcctttgct

SEQ ID NO: 2850 - DNA, 17 bp, Artificial sequence
  Synthesized sequence
ctggcaccgggccggcc

SEQ ID NO: 2851 - DNA, 17 bp, Artificial sequence
  Synthesized sequence
ctggccagcgacctgcc

SEQ ID NO: 2852 - DNA, 17 bp, Artificial sequence
  Synthesized sequence
gcgtcacgtctgctgct

SEQ ID NO: 2853 - DNA, 17 bp, Artificial sequence
  Synthesized sequence
ccggcgctgatcgtgct

SEQ ID NO: 2854 - DNA, 17 bp, Artificial sequence
  Synthesized sequence
ctggcccgcgcgctgta

SEQ ID NO: 2855 - DNA, 17 bp, Artificial sequence
  Synthesized sequence
ccggcgcggcccgtgcc

SEQ ID NO: 2856 - DNA, 17 bp, Artificial sequence
  Synthesized sequence
ttggcggggaaatcgcc

SEQ ID NO: 2857 - DNA, 17 bp, Artificial sequence
  Synthesized sequence
cgggccgggccgttgcc

SEQ ID NO: 2858 - DNA, 17 bp, Artificial sequence
  Synthesized sequence
gtggccgcgcactggca

SEQ ID NO: 2859 - DNA, 17 bp, Artificial sequence
  Synthesized sequence
ctggcgcagccggagct

SEQ ID NO: 2860 - DNA, 17 bp, Artificial sequence
  Synthesized sequence
ctggctcgcgcgctgat

SEQ ID NO: 2861 - DNA, 17 bp, Artificial sequence
  Synthesized sequence
caggatcagcaattgca

SEQ ID NO: 2862 - DNA, 17 bp, Artificial sequence
  Synthesized sequence
gtggtgcgcggcttcct

SEQ ID NO: 2863 - DNA, 17 bp, Artificial sequence
  Synthesized sequence
ctggtatggatggggct

SEQ ID NO: 2864 - DNA, 17 bp, Artificial sequence
  Synthesized sequence
gtgccgcaggtgctgct

SEQ ID NO: 2865 - DNA, 17 bp, Artificial sequence
  Synthesized sequence
cgggctttgcggttgca

SEQ ID NO: 2866 - DNA, 17 bp, Artificial sequence
  Synthesized sequence
agggcatggtcctggcc

SEQ ID NO: 2867 - DNA, 17 bp, Artificial sequence
  Synthesized sequence
caagctcgacagttgct

SEQ ID NO: 2868 - DNA, 17 bp, Artificial sequence
  Synthesized sequence
gccgcacggttgatgca

SEQ ID NO: 2869 - DNA, 17 bp, Artificial sequence
  Synthesized sequence
ctggcccgcctcgagcg

SEQ ID NO: 2870 - DNA, 17 bp, Artificial sequence
  Synthesized sequence
ttcgaactgaccttgcg

SEQ ID NO: 2871 - DNA, 17 bp, Artificial sequence
  Synthesized sequence
gcggcaccggtgtggcc

SEQ ID NO: 2872 - DNA, 17 bp, Artificial sequence
  Synthesized sequence
gttgcgcggctgtttca

SEQ ID NO: 2873 - DNA, 17 bp, Artificial sequence
  Synthesized sequence
ttggcggggcgctcgcc

SEQ ID NO: 2874 - DNA, 17 bp, Artificial sequence
  Synthesized sequence
tcggcatgacgatggcg

SEQ ID NO: 2875 - DNA, 17 bp, Artificial sequence
  Synthesized sequence
caggccccagtcctgct

SEQ ID NO: 2876 - DNA, 17 bp, Artificial sequence
  Synthesized sequence
ctggccgaactggtgcg

SEQ ID NO: 2877 - DNA, 17 bp, Artificial sequence
  Synthesized sequence
gtgggtcggcgtctgcg

SEQ ID NO: 2878 - DNA, 17 bp, Artificial sequence
  Synthesized sequence
ctggcccgcgaggtgga

SEQ ID NO: 2879 - DNA, 17 bp, Artificial sequence
  Synthesized sequence
ttggcacgttacccgat

SEQ ID NO: 2880 - DNA, 17 bp, Artificial sequence
  Synthesized sequence
gcggcgcggaccttcca

SEQ ID NO: 2881 - DNA, 17 bp, Artificial sequence
  Synthesized sequence
ctggacctgttctggct

SEQ ID NO: 2882 - DNA, 17 bp, Artificial sequence
  Synthesized sequence
ttggcgccgctgctgat

SEQ ID NO: 2883 - DNA, 17 bp, Artificial sequence
  Synthesized sequence
gtggaacgtccggtgat

SEQ ID NO: 2884 - DNA, 17 bp, Artificial sequence
  Synthesized sequence
atggcacagcacaaggt

SEQ ID NO: 2885 - DNA, 17 bp, Artificial sequence
  Synthesized sequence
ctcgcaccctgttcgca

SEQ ID NO: 2886 - DNA, 17 bp, Artificial sequence
  Synthesized sequence
ctggccatcgacgtgct

SEQ ID NO: 2887 - DNA, 17 bp, Artificial sequence
  Synthesized sequence
tcggcatgggcgtcgcg

SEQ ID NO: 2888 - DNA, 17 bp, Artificial sequence
  Synthesized sequence
atggcccgcgccatgga

SEQ ID NO: 2889 - DNA, 17 bp, Artificial sequence
  Synthesized sequence
tagggataggtcttgcc

SEQ ID NO: 2890 - DNA, 17 bp, Artificial sequence
  Synthesized sequence
ctggaccgcaccttcca

SEQ ID NO: 2891 - DNA, 17 bp, Artificial sequence
  Synthesized sequence
gcggcacgagctcggca

SEQ ID NO: 2892 - DNA, 17 bp, Artificial sequence
  Synthesized sequence
ccggcgggaccgttgcg

SEQ ID NO: 2893 - DNA, 17 bp, Artificial sequence
  Synthesized sequence
atggcctgatcatcgcc

SEQ ID NO: 2894 - DNA, 17 bp, Artificial sequence
  Synthesized sequence
atggcgtgtacactgcc

SEQ ID NO: 2895 - DNA, 17 bp, Artificial sequence
  Synthesized sequence
tcggcaagggccatgcc

SEQ ID NO: 2896 - DNA, 17 bp, Artificial sequence
  Synthesized sequence
ctggcgatcaagctgct

SEQ ID NO: 2897 - DNA, 17 bp, Artificial sequence
  Synthesized sequence
atggcccggggagggca

SEQ ID NO: 2898 - DNA, 17 bp, Artificial sequence
  Synthesized sequence
ctggccagccgctcgcg

SEQ ID NO: 2899 - DNA, 17 bp, Artificial sequence
  Synthesized sequence
atggccatcgccctgct

SEQ ID NO: 2900 - DNA, 17 bp, Artificial sequence
  Synthesized sequence
gagggacgggcgtcgct

SEQ ID NO: 2901 - DNA, 17 bp, Artificial sequence
  Synthesized sequence
ttggccgggtccttggg

SEQ ID NO: 2902 - DNA, 17 bp, Artificial sequence
  Synthesized sequence
gcgggacggcgcctgcg

SEQ ID NO: 2903 - DNA, 17 bp, Artificial sequence
  Synthesized sequence
atggccagccgctggcg

SEQ ID NO: 2904 - DNA, 17 bp, Artificial sequence
  Synthesized sequence
atggcgcgagcggagca

SEQ ID NO: 2905 - DNA, 17 bp, Artificial sequence
  Synthesized sequence
gtggttccgcgcatgct

SEQ ID NO: 2906 - DNA, 17 bp, Artificial sequence
  Synthesized sequence
atggggcggtacctgcg

SEQ ID NO: 2907 - DNA, 17 bp, Artificial sequence
  Synthesized sequence
gtggcctgttggctgcg

SEQ ID NO: 2908 - DNA, 17 bp, Artificial sequence
  Synthesized sequence
atggccaagatgatgcg

SEQ ID NO: 2909 - DNA, 17 bp, Artificial sequence
  Synthesized sequence
cttccacgggggttgcg

SEQ ID NO: 2910 - DNA, 17 bp, Artificial sequence
  Synthesized sequence
cggggtcagcaattgct

SEQ ID NO: 2911 - DNA, 17 bp, Artificial sequence
  Synthesized sequence
ttggcgggggcggtgcg

SEQ ID NO: 2912 - DNA, 17 bp, Artificial sequence
  Synthesized sequence
gtggcgccgcacaggct

SEQ ID NO: 2913 - DNA, 17 bp, Artificial sequence
  Synthesized sequence
ctggccgaagcctcgca

SEQ ID NO: 2914 - DNA, 17 bp, Artificial sequence
  Synthesized sequence
ctgggtcggcgtctgcg

SEQ ID NO: 2915 - DNA, 17 bp, Artificial sequence
  Synthesized sequence
atggcgcagtaccagca

SEQ ID NO: 2916 - DNA, 17 bp, Artificial sequence
  Synthesized sequence
ctggcgctgctccggca

SEQ ID NO: 2917 - DNA, 17 bp, Artificial sequence
  Synthesized sequence
ctggcccacccggcgct

SEQ ID NO: 2918 - DNA, 17 bp, Artificial sequence
  Synthesized sequence
gtggtgccgctttcgca

SEQ ID NO: 2919 - DNA, 17 bp, Artificial sequence
  Synthesized sequence
ccggcacgctctccgca

SEQ ID NO: 2920 - DNA, 17 bp, Artificial sequence
  Synthesized sequence
ctggccggtgccttcct

SEQ ID NO: 2921 - DNA, 17 bp, Artificial sequence
  Synthesized sequence
ctggaacgcgcggcgca

SEQ ID NO: 2922 - DNA, 17 bp, Artificial sequence
  Synthesized sequence
ttggcatccttctcgtt

SEQ ID NO: 2923 - DNA, 17 bp, Artificial sequence
  Synthesized sequence
ctggcgggcacggtgcg

SEQ ID NO: 2924 - DNA, 17 bp, Artificial sequence
  Synthesized sequence
ctggtcaggcaactgct

SEQ ID NO: 2925 - DNA, 17 bp, Artificial sequence
  Synthesized sequence
ttgacccagtacctgct

SEQ ID NO: 2926 - DNA, 17 bp, Artificial sequence
  Synthesized sequence
ttgacccagtacctgct

SEQ ID NO: 2927 - DNA, 17 bp, Artificial sequence
  Synthesized sequence
aaggcaaccatcatgca

SEQ ID NO: 2928 - DNA, 17 bp, Artificial sequence
  Synthesized sequence
gagatacgcccgttgct

SEQ ID NO: 2929 - DNA, 17 bp, Artificial sequence
  Synthesized sequence
gtggcgccgttcctgtt

SEQ ID NO: 2930 - DNA, 17 bp, Artificial sequence
  Synthesized sequence
gtggaacgcggcgggca

SEQ ID NO: 2931 - DNA, 17 bp, Artificial sequence
  Synthesized sequence
gtggcccactacctgtt

SEQ ID NO: 2932 - DNA, 17 bp, Artificial sequence
  Synthesized sequence
ctggcaagtccctatca

SEQ ID NO: 2933 - DNA, 17 bp, Artificial sequence
  Synthesized sequence
ttgtcgcagatcatgca

SEQ ID NO: 2934 - DNA, 17 bp, Artificial sequence
  Synthesized sequence
ccgggccgagcgttgca

SEQ ID NO: 2935 - DNA, 17 bp, Artificial sequence
  Synthesized sequence
atggcgtcggctttgat

SEQ ID NO: 2936 - DNA, 17 bp, Artificial sequence
  Synthesized sequence
ctggcccggttgttcga

SEQ ID NO: 2937 - DNA, 17 bp, Artificial sequence
  Synthesized sequence
caggcccggtcatggca

SEQ ID NO: 2938 - DNA, 17 bp, Artificial sequence
  Synthesized sequence
tcggcatacaccttcca

SEQ ID NO: 2939 - DNA, 17 bp, Artificial sequence
  Synthesized sequence
ctgggaatccactggct

SEQ ID NO: 2940 - DNA, 17 bp, Artificial sequence
  Synthesized sequence
atggcatgccaggtggc

SEQ ID NO: 2941 - DNA, 17 bp, Artificial sequence
  Synthesized sequence
ttggaacacatccttca

SEQ ID NO: 2942 - DNA, 17 bp, Artificial sequence
  Synthesized sequence
gtggtcggcatcctgct

SEQ ID NO: 2943 - DNA, 17 bp, Artificial sequence
  Synthesized sequence
ctggaagcccgtctgct

SEQ ID NO: 2944 - DNA, 17 bp, Artificial sequence
  Synthesized sequence
ttggcgcgaggtaagca

SEQ ID NO: 2945 - DNA, 17 bp, Artificial sequence
  Synthesized sequence
cgagcacggttttggct

SEQ ID NO: 2946 - DNA, 17 bp, Artificial sequence
  Synthesized sequence
ccggaacagcactttct

SEQ ID NO: 2947 - DNA, 17 bp, Artificial sequence
  Synthesized sequence
atggccggatcgatgcg

SEQ ID NO: 2948 - DNA, 17 bp, Artificial sequence
  Synthesized sequence
atggcccgcgaggtgat

SEQ ID NO: 2949 - DNA, 17 bp, Artificial sequence
  Synthesized sequence
atgggccgtcgatggct

SEQ ID NO: 2950 - DNA, 17 bp, Artificial sequence
  Synthesized sequence
gcggcaggctggttgta

SEQ ID NO: 2951 - DNA, 17 bp, Artificial sequence
  Synthesized sequence
ctggccgtcggcctgct

SEQ ID NO: 2952 - DNA, 17 bp, Artificial sequence
  Synthesized sequence
gcggcgaaagcgttgca

SEQ ID NO: 2953 - DNA, 17 bp, Artificial sequence
  Synthesized sequence
atggcgccgatccagca

SEQ ID NO: 2954 - DNA, 17 bp, Artificial sequence
  Synthesized sequence
ctggcgcagcccaagca

SEQ ID NO: 2955 - DNA, 17 bp, Artificial sequence
  Synthesized sequence
ctggtgctctacctgct

SEQ ID NO: 2956 - DNA, 17 bp, Artificial sequence
  Synthesized sequence
gtgggacgcgcagcgct

SEQ ID NO: 2957 - DNA, 17 bp, Artificial sequence
  Synthesized sequence
ctgggcctgaccctgct

SEQ ID NO: 2958 - DNA, 17 bp, Artificial sequence
  Synthesized sequence
ttcggccgcgccttgct

SEQ ID NO: 2959 - DNA, 17 bp, Artificial sequence
  Synthesized sequence
tcgccaggccgattgca

SEQ ID NO: 2960 - DNA, 17 bp, Artificial sequence
  Synthesized sequence
gcggcacgctgtccgca

SEQ ID NO: 2961 - DNA, 17 bp, Artificial sequence
  Synthesized sequence
atggcttaccgattcca

SEQ ID NO: 2962 - DNA, 17 bp, Artificial sequence
  Synthesized sequence
ctggcggtgccctggct

SEQ ID NO: 2963 - DNA, 17 bp, Artificial sequence
  Synthesized sequence
ctggccatcgccatgct

SEQ ID NO: 2964 - DNA, 17 bp, Artificial sequence
  Synthesized sequence
ctggcagcgcgcctggt

SEQ ID NO: 2965 - DNA, 17 bp, Artificial sequence
  Synthesized sequence
ctggtgctgttctggct

SEQ ID NO: 2966 - DNA, 17 bp, Artificial sequence
  Synthesized sequence
ctggcccgttacctgga

SEQ ID NO: 2967 - DNA, 17 bp, Artificial sequence
  Synthesized sequence
gcggcgccggcattgcc

SEQ ID NO: 2968 - DNA, 17 bp, Artificial sequence
  Synthesized sequence
ctggcggccgccgtgct

SEQ ID NO: 2969 - DNA, 17 bp, Artificial sequence
  Synthesized sequence
ctggctgaccattagca

SEQ ID NO: 2970 - DNA, 17 bp, Artificial sequence
  Synthesized sequence
ctggagcagctcatgcc

SEQ ID NO: 2971 - DNA, 17 bp, Artificial sequence
  Synthesized sequence
gtggcgcggctgcagcg

SEQ ID NO: 2972 - DNA, 17 bp, Artificial sequence
  Synthesized sequence
ctgggaagacaatcgcg

SEQ ID NO: 2973 - DNA, 17 bp, Artificial sequence
  Synthesized sequence
atggcacggcggcgcct

SEQ ID NO: 2974 - DNA, 17 bp, Artificial sequence
  Synthesized sequence
gtggaaggcgacatgcc

SEQ ID NO: 2975 - DNA, 17 bp, Artificial sequence
  Synthesized sequence
ctgggccaggggctgca

SEQ ID NO: 2976 - DNA, 17 bp, Artificial sequence
  Synthesized sequence
ctgggccgagttctgcg

SEQ ID NO: 2977 - DNA, 17 bp, Artificial sequence
  Synthesized sequence
atggcgccggcatcgcc

SEQ ID NO: 2978 - DNA, 17 bp, Artificial sequence
  Synthesized sequence
caggcgcacatggtgca

SEQ ID NO: 2979 - DNA, 17 bp, Artificial sequence
  Synthesized sequence
caggaacgactggtgcg

SEQ ID NO: 2980 - DNA, 17 bp, Artificial sequence
  Synthesized sequence
agggcagaccatttgtt

SEQ ID NO: 2981 - DNA, 17 bp, Artificial sequence
  Synthesized sequence
ggggaatagcggttgcg

SEQ ID NO: 2982 - DNA, 17 bp, Artificial sequence
  Synthesized sequence
ctggcgccggcttcgcc

SEQ ID NO: 2983 - DNA, 17 bp, Artificial sequence
  Synthesized sequence
ttggcgcctccctggcg

SEQ ID NO: 2984 - DNA, 17 bp, Artificial sequence
  Synthesized sequence
ctggcgcacatgctgtt

SEQ ID NO: 2985 - DNA, 17 bp, Artificial sequence
  Synthesized sequence
atgaaactcctattgcc

SEQ ID NO: 2986 - DNA, 17 bp, Artificial sequence
  Synthesized sequence
ctggtactgggcttggc

SEQ ID NO: 2987 - DNA, 17 bp, Artificial sequence
  Synthesized sequence
ctggtatgccggtttcg

SEQ ID NO: 2988 - DNA, 17 bp, Artificial sequence
  Synthesized sequence
acggcgccgttgctgct

SEQ ID NO: 2989 - DNA, 17 bp, Artificial sequence
  Synthesized sequence
ctggaacaggtgctgga

SEQ ID NO: 2990 - DNA, 17 bp, Artificial sequence
  Synthesized sequence
gtgccattgagcctgct

SEQ ID NO: 2991 - DNA, 17 bp, Artificial sequence
  Synthesized sequence
gttgaacggcaatggca

SEQ ID NO: 2992 - DNA, 17 bp, Artificial sequence
  Synthesized sequence
gtggcagacgccgtggt

SEQ ID NO: 2993 - DNA, 17 bp, Artificial sequence
  Synthesized sequence
ctggcagcgttcgtgga

SEQ ID NO: 2994 - DNA, 17 bp, Artificial sequence
  Synthesized sequence
gtgccaaaggccgtgct

SEQ ID NO: 2995 - DNA, 17 bp, Artificial sequence
  Synthesized sequence
atggcctgcgcttcgcg

SEQ ID NO: 2996 - DNA, 17 bp, Artificial sequence
  Synthesized sequence
gtggccaggtactggcc

SEQ ID NO: 2997 - DNA, 17 bp, Artificial sequence
  Synthesized sequence
ctggccatgcgttggct

SEQ ID NO: 2998 - DNA, 17 bp, Artificial sequence
  Synthesized sequence
ctggtaatggcgctgct

SEQ ID NO: 2999 - DNA, 17 bp, Artificial sequence
  Synthesized sequence
atggcctgcgcttcgcg

SEQ ID NO: 3000 - DNA, 17 bp, Artificial sequence
  Synthesized sequence
ctggaacgacgcttcgt

SEQ ID NO: 3001 - DNA, 17 bp, Artificial sequence
  Synthesized sequence
tgggcgcagcaggtgca

SEQ ID NO: 3002 - DNA, 17 bp, Artificial sequence
  Synthesized sequence
ctggcccgcgagctgga

SEQ ID NO: 3003 - DNA, 17 bp, Artificial sequence
  Synthesized sequence
gtggcgcgatattcgtt

SEQ ID NO: 3004 - DNA, 17 bp, Artificial sequence
  Synthesized sequence
ctggtgctgagcctgct

SEQ ID NO: 3005 - DNA, 17 bp, Artificial sequence
  Synthesized sequence
gtggccagccgttcgcg

SEQ ID NO: 3006 - DNA, 17 bp, Artificial sequence
  Synthesized sequence
ctgcgtcgccagttgct

SEQ ID NO: 3007 - DNA, 17 bp, Artificial sequence
  Synthesized sequence
atgccgcgcagcctgct

SEQ ID NO: 3008 - DNA, 17 bp, Artificial sequence
  Synthesized sequence
ccggcaccgggctggcg

SEQ ID NO: 3009 - DNA, 17 bp, Artificial sequence
  Synthesized sequence
ctggaagacctgctgcc

SEQ ID NO: 3010 - DNA, 17 bp, Artificial sequence
  Synthesized sequence
ctgatgcaactgttgct

SEQ ID NO: 3011 - DNA, 17 bp, Artificial sequence
  Synthesized sequence
ctggagccggtgctgct

SEQ ID NO: 3012 - DNA, 17 bp, Artificial sequence
  Synthesized sequence
ctgcggcgagccttgct

SEQ ID NO: 3013 - DNA, 17 bp, Artificial sequence
  Synthesized sequence
gtgcgacgcgacatgct

SEQ ID NO: 3014 - DNA, 17 bp, Artificial sequence
  Synthesized sequence
atggctttctcggtgct

SEQ ID NO: 3015 - DNA, 17 bp, Artificial sequence
  Synthesized sequence
tcggcgctaccattgcc

SEQ ID NO: 3016 - DNA, 17 bp, Artificial sequence
  Synthesized sequence
atgggcaacctgttgcg

SEQ ID NO: 3017 - DNA, 17 bp, Artificial sequence
  Synthesized sequence
ttggccagcagcgtgcc

SEQ ID NO: 3018 - DNA, 17 bp, Artificial sequence
  Synthesized sequence
ctgtcgttgcgcttgct

SEQ ID NO: 3019 - DNA, 17 bp, Artificial sequence
  Synthesized sequence
ctggcaaggtgtccgcg

SEQ ID NO: 3020 - DNA, 17 bp, Artificial sequence
  Synthesized sequence
ctggcggatgaggtgct

SEQ ID NO: 3021 - DNA, 17 bp, Artificial sequence
  Synthesized sequence
ctgggatcgggttggct

SEQ ID NO: 3022 - DNA, 17 bp, Artificial sequence
  Synthesized sequence
atggcgaggcggtggcg

SEQ ID NO: 3023 - DNA, 17 bp, Artificial sequence
  Synthesized sequence
ctggcagtgaccccgct

SEQ ID NO: 3024 - DNA, 17 bp, Artificial sequence
  Synthesized sequence
ctgggccgagcgttcct

SEQ ID NO: 3025 - DNA, 17 bp, Artificial sequence
  Synthesized sequence
ctggatcgccgatggca

SEQ ID NO: 3026 - DNA, 17 bp, Artificial sequence
  Synthesized sequence
ctggcgatcgccctgct

SEQ ID NO: 3027 - DNA, 17 bp, Artificial sequence
  Synthesized sequence
ctgccgcaggtgctgct

SEQ ID NO: 3028 - DNA, 17 bp, Artificial sequence
  Synthesized sequence
tgggcatggcggtagcc

SEQ ID NO: 3029 - DNA, 17 bp, Artificial sequence
  Synthesized sequence
atgacgccgccattgcc

SEQ ID NO: 3030 - DNA, 17 bp, Artificial sequence
  Synthesized sequence
ctggcactggcgcagcc

SEQ ID NO: 3031 - DNA, 17 bp, Artificial sequence
  Synthesized sequence
agggcatgcagctcgcg

SEQ ID NO: 3032 - DNA, 17 bp, Artificial sequence
  Synthesized sequence
ctggcgcagctgctcca

SEQ ID NO: 3033 - DNA, 17 bp, Artificial sequence
  Synthesized sequence
ttggtgctggccgtgct

SEQ ID NO: 3034 - DNA, 17 bp, Artificial sequence
  Synthesized sequence
gtgggtgtccagttgct

SEQ ID NO: 3035 - DNA, 17 bp, Artificial sequence
  Synthesized sequence
ctggcagcagggtggcg

SEQ ID NO: 3036 - DNA, 17 bp, Artificial sequence
  Synthesized sequence
gtagcgcggcgcttcct

SEQ ID NO: 3037 - DNA, 17 bp, Artificial sequence
  Synthesized sequence
ttggccggatcgctgcc

SEQ ID NO: 3038 - DNA, 17 bp, Artificial sequence
  Synthesized sequence
gtggtacgtgaagggct

SEQ ID NO: 3039 - DNA, 17 bp, Artificial sequence
  Synthesized sequence
atggcgctgatcctgat

SEQ ID NO: 3040 - DNA, 17 bp, Artificial sequence
  Synthesized sequence
ctggaacagcaggagca

SEQ ID NO: 3041 - DNA, 17 bp, Artificial sequence
  Synthesized sequence
ggggaccaccacttgca

SEQ ID NO: 3042 - DNA, 17 bp, Artificial sequence
  Synthesized sequence
atggcttgccagttgtc

SEQ ID NO: 3043 - DNA, 17 bp, Artificial sequence
  Synthesized sequence
ctggtgctgccgctgct

SEQ ID NO: 3044 - DNA, 17 bp, Artificial sequence
  Synthesized sequence
cgggcatgacggtcgcc

SEQ ID NO: 3045 - DNA, 17 bp, Artificial sequence
  Synthesized sequence
gcggcaccatcgatgcg

SEQ ID NO: 3046 - DNA, 17 bp, Artificial sequence
  Synthesized sequence
gtggcccgcccctgcct

SEQ ID NO: 3047 - DNA, 17 bp, Artificial sequence
  Synthesized sequence
ctggaccctgctttgcg

SEQ ID NO: 3048 - DNA, 17 bp, Artificial sequence
  Synthesized sequence
ctggaccaggtattgaa

SEQ ID NO: 3049 - DNA, 17 bp, Artificial sequence
  Synthesized sequence
gaggaactgctctggct

SEQ ID NO: 3050 - DNA, 17 bp, Artificial sequence
  Synthesized sequence
ctcgccgaccaattgct

SEQ ID NO: 3051 - DNA, 17 bp, Artificial sequence
  Synthesized sequence
gtggccagggccttgag

SEQ ID NO: 3052 - DNA, 17 bp, Artificial sequence
  Synthesized sequence
ctggagcagatgttcct

SEQ ID NO: 3053 - DNA, 17 bp, Artificial sequence
  Synthesized sequence
ttggcgcccgcgatgcg

SEQ ID NO: 3054 - DNA, 17 bp, Artificial sequence
  Synthesized sequence
gtggaacaattgctgga

SEQ ID NO: 3055 - DNA, 17 bp, Artificial sequence
  Synthesized sequence
tagccacaagccttgcg

SEQ ID NO: 3056 - DNA, 17 bp, Artificial sequence
  Synthesized sequence
ctcgcacgggtctcgtt

SEQ ID NO: 3057 - DNA, 17 bp, Artificial sequence
  Synthesized sequence
ctggaaaacccgttcct

SEQ ID NO: 3058 - DNA, 17 bp, Artificial sequence
  Synthesized sequence
ctggcacgcgggtttgc

SEQ ID NO: 3059 - DNA, 17 bp, Artificial sequence
  Synthesized sequence
ctggcagaagatgggca

SEQ ID NO: 3060 - DNA, 17 bp, Artificial sequence
  Synthesized sequence
gaggcgctgatcgtgct

SEQ ID NO: 3061 - DNA, 17 bp, Artificial sequence
  Synthesized sequence
ctcgaacgacgctggca

SEQ ID NO: 3062 - DNA, 17 bp, Artificial sequence
  Synthesized sequence
ctggcctgctgctggcg

SEQ ID NO: 3063 - DNA, 17 bp, Artificial sequence
  Synthesized sequence
atggaaaaggacctgcg

SEQ ID NO: 3064 - DNA, 17 bp, Artificial sequence
  Synthesized sequence
ctggcgggattcttccg

SEQ ID NO: 3065 - DNA, 17 bp, Artificial sequence
  Synthesized sequence
gtggcgtgtctgtttcg

SEQ ID NO: 3066 - DNA, 17 bp, Artificial sequence
  Synthesized sequence
ctggccggtgccttcct

SEQ ID NO: 3067 - DNA, 17 bp, Artificial sequence
  Synthesized sequence
aaggcacgggcgacgca

SEQ ID NO: 3068 - DNA, 17 bp, Artificial sequence
  Synthesized sequence
agggcgccaaggttgcc

SEQ ID NO: 3069 - DNA, 17 bp, Artificial sequence
  Synthesized sequence
ttggaattttttttgat

SEQ ID NO: 3070 - DNA, 17 bp, Artificial sequence
  Synthesized sequence
atgccgcggatgttgta

SEQ ID NO: 3071 - DNA, 17 bp, Artificial sequence
  Synthesized sequence
ctggctggcgctttcca

SEQ ID NO: 3072 - DNA, 17 bp, Artificial sequence
  Synthesized sequence
acggccaggccgttgcc

SEQ ID NO: 3073 - DNA, 17 bp, Artificial sequence
  Synthesized sequence
ctggaacaggccgggct

SEQ ID NO: 3074 - DNA, 17 bp, Artificial sequence
  Synthesized sequence
ctggcccaggtactggt

SEQ ID NO: 3075 - DNA, 17 bp, Artificial sequence
  Synthesized sequence
ctcgcacgcggctttcg

SEQ ID NO: 3076 - DNA, 17 bp, Artificial sequence
  Synthesized sequence
ctggcttccgactggct

SEQ ID NO: 3077 - DNA, 17 bp, Artificial sequence
  Synthesized sequence
gtggcccttgcgttcca

SEQ ID NO: 3078 - DNA, 17 bp, Artificial sequence
  Synthesized sequence
tcagcacgtgccttgcc

SEQ ID NO: 3079 - DNA, 17 bp, Artificial sequence
  Synthesized sequence
gttccaggagtcttgca

SEQ ID NO: 3080 - DNA, 17 bp, Artificial sequence
  Synthesized sequence
ctgggacgcctaccgcg

SEQ ID NO: 3081 - DNA, 17 bp, Artificial sequence
  Synthesized sequence
ccggcacgcctttgcct

SEQ ID NO: 3082 - DNA, 17 bp, Artificial sequence
  Synthesized sequence
gtggcctgtcgctcgcc

SEQ ID NO: 3083 - DNA, 17 bp, Artificial sequence
  Synthesized sequence
ccggcacaaaaccggct

SEQ ID NO: 3084 - DNA, 17 bp, Artificial sequence
  Synthesized sequence
aaggcgcggtgatggct

SEQ ID NO: 3085 - DNA, 17 bp, Artificial sequence
  Synthesized sequence
ctgccgcgcggcctgct

SEQ ID NO: 3086 - DNA, 17 bp, Artificial sequence
  Synthesized sequence
ctggaatggctgccgca

SEQ ID NO: 3087 - DNA, 17 bp, Artificial sequence
  Synthesized sequence
cgggcccagggcctgca

SEQ ID NO: 3088 - DNA, 17 bp, Artificial sequence
  Synthesized sequence
ctgggtcgggtcctgcc

SEQ ID NO: 3089 - DNA, 17 bp, Artificial sequence
  Synthesized sequence
cttgcgcgccagctgca

SEQ ID NO: 3090 - DNA, 17 bp, Artificial sequence
  Synthesized sequence
ggggcgcgctgggtgca

SEQ ID NO: 3091 - DNA, 17 bp, Artificial sequence
  Synthesized sequence
ctgcccgagccgttgca

SEQ ID NO: 3092 - DNA, 17 bp, Artificial sequence
  Synthesized sequence
taggccagccagttgcg

SEQ ID NO: 3093 - DNA, 17 bp, Artificial sequence
  Synthesized sequence
ctggaaggtgccttgaa

SEQ ID NO: 3094 - DNA, 17 bp, Artificial sequence
  Synthesized sequence
ctggcgccgatcgtggt

SEQ ID NO: 3095 - DNA, 17 bp, Artificial sequence
  Synthesized sequence
ctggcgctgatcatgat

SEQ ID NO: 3096 - DNA, 17 bp, Artificial sequence
  Synthesized sequence
ctcgcgcggtactggca

SEQ ID NO: 3097 - DNA, 17 bp, Artificial sequence
  Synthesized sequence
atggcttcctcgctgca

SEQ ID NO: 3098 - DNA, 17 bp, Artificial sequence
  Synthesized sequence
gtggcagcgccagcgct

SEQ ID NO: 3099 - DNA, 17 bp, Artificial sequence
  Synthesized sequence
ctggcccagcgcgtgga

SEQ ID NO: 3100 - DNA, 17 bp, Artificial sequence
  Synthesized sequence
ctggcccggcacgcgcc

SEQ ID NO: 3101 - DNA, 17 bp, Artificial sequence
  Synthesized sequence
gtggataggctgctgct

SEQ ID NO: 3102 - DNA, 17 bp, Artificial sequence
  Synthesized sequence
ctggcgcggctgctgtg

SEQ ID NO: 3103 - DNA, 17 bp, Artificial sequence
  Synthesized sequence
gtggggctttttttgcc

SEQ ID NO: 3104 - DNA, 17 bp, Artificial sequence
  Synthesized sequence
ctggaatcagcctcgca

SEQ ID NO: 3105 - DNA, 17 bp, Artificial sequence
  Synthesized sequence
ctggccgaccccttcca

SEQ ID NO: 3106 - DNA, 17 bp, Artificial sequence
  Synthesized sequence
gcggcaagcggcttact

SEQ ID NO: 3107 - DNA, 17 bp, Artificial sequence
  Synthesized sequence
gtgccaccgccgctgcc

SEQ ID NO: 3108 - DNA, 17 bp, Artificial sequence
  Synthesized sequence
ctggcgcaccgaccgct

SEQ ID NO: 3109 - DNA, 17 bp, Artificial sequence
  Synthesized sequence
gtggcccggctggcgcc

SEQ ID NO: 3110 - DNA, 17 bp, Artificial sequence
  Synthesized sequence
ttggcgagggcgatgcg

SEQ ID NO: 3111 - DNA, 17 bp, Artificial sequence
  Synthesized sequence
ccggcacgagacgagca

SEQ ID NO: 3112 - DNA, 17 bp, Artificial sequence
  Synthesized sequence
ctggcgctgatcctgtt

SEQ ID NO: 3113 - DNA, 17 bp, Artificial sequence
  Synthesized sequence
ctggttcagcgattgtt

SEQ ID NO: 3114 - DNA, 17 bp, Artificial sequence
  Synthesized sequence
ttggcgcagagcctgat

SEQ ID NO: 3115 - DNA, 17 bp, Artificial sequence
  Synthesized sequence
ccggcctggctctggca

SEQ ID NO: 3116 - DNA, 17 bp, Artificial sequence
  Synthesized sequence
gtggcgacgctgttcca

SEQ ID NO: 3117 - DNA, 17 bp, Artificial sequence
  Synthesized sequence
ctggcgagcgtctcgcg

SEQ ID NO: 3118 - DNA, 17 bp, Artificial sequence
  Synthesized sequence
gtgcaacagcaactgct

SEQ ID NO: 3119 - DNA, 17 bp, Artificial sequence
  Synthesized sequence
agggcaaggcattcgcc

SEQ ID NO: 3120 - DNA, 17 bp, Artificial sequence
  Synthesized sequence
gtggcgggggtgtcgcc

SEQ ID NO: 3121 - DNA, 17 bp, Artificial sequence
  Synthesized sequence
gaggaatttcagttgct

SEQ ID NO: 3122 - DNA, 17 bp, Artificial sequence
  Synthesized sequence
gcggaagatcgattgct

SEQ ID NO: 3123 - DNA, 17 bp, Artificial sequence
  Synthesized sequence
gcggcgaacaggttgct

SEQ ID NO: 3124 - DNA, 17 bp, Artificial sequence
  Synthesized sequence
ctgtcacgaagcgcgct

SEQ ID NO: 3125 - DNA, 17 bp, Artificial sequence
  Synthesized sequence
ttgccaggccgcttgga

SEQ ID NO: 3126 - DNA, 17 bp, Artificial sequence
  Synthesized sequence
gtggcgcggctgacgcg

SEQ ID NO: 3127 - DNA, 17 bp, Artificial sequence
  Synthesized sequence
ctggtcgccgccttgca

SEQ ID NO: 3128 - DNA, 17 bp, Artificial sequence
  Synthesized sequence
tgggcgcgcgcctcgct

SEQ ID NO: 3129 - DNA, 17 bp, Artificial sequence
  Synthesized sequence
aaggcccgcctgctgcg

SEQ ID NO: 3130 - DNA, 17 bp, Artificial sequence
  Synthesized sequence
ctgggccgagtggtgcg

SEQ ID NO: 3131 - DNA, 17 bp, Artificial sequence
  Synthesized sequence
ctggcgcaatacctgat

SEQ ID NO: 3132 - DNA, 17 bp, Artificial sequence
  Synthesized sequence
gaggcaagccgtttcca

SEQ ID NO: 3133 - DNA, 17 bp, Artificial sequence
  Synthesized sequence
tcggcaggactgtggcg

SEQ ID NO: 3134 - DNA, 17 bp, Artificial sequence
  Synthesized sequence
ctggactggcaggtgca

SEQ ID NO: 3135 - DNA, 17 bp, Artificial sequence
  Synthesized sequence
ctggatcagtttttcct

SEQ ID NO: 3136 - DNA, 17 bp, Artificial sequence
  Synthesized sequence
acggctcgccagttgtt

SEQ ID NO: 3137 - DNA, 17 bp, Artificial sequence
  Synthesized sequence
ctggaactgctggcgct

SEQ ID NO: 3138 - DNA, 17 bp, Artificial sequence
  Synthesized sequence
ttgcctcggcattcgct

SEQ ID NO: 3139 - DNA, 17 bp, Artificial sequence
  Synthesized sequence
ttgcctcggcattcgct

SEQ ID NO: 3140 - DNA, 17 bp, Artificial sequence
  Synthesized sequence
gtgtgccggggcttgca

SEQ ID NO: 3141 - DNA, 17 bp, Artificial sequence
  Synthesized sequence
tggcgacgggtattgct

SEQ ID NO: 3142 - DNA, 17 bp, Artificial sequence
  Synthesized sequence
ctggcattgcggtcgat

SEQ ID NO: 3143 - DNA, 17 bp, Artificial sequence
  Synthesized sequence
aggggacggagcttcct

SEQ ID NO: 3144 - DNA, 17 bp, Artificial sequence
  Synthesized sequence
atggcctggtaccggct

SEQ ID NO: 3145 - DNA, 17 bp, Artificial sequence
  Synthesized sequence
gggccacccaggttgca

SEQ ID NO: 3146 - DNA, 17 bp, Artificial sequence
  Synthesized sequence
ctggtgccgaccatgct

SEQ ID NO: 3147 - DNA, 17 bp, Artificial sequence
  Synthesized sequence
caggaactggtcctgct

SEQ ID NO: 3148 - DNA, 17 bp, Artificial sequence
  Synthesized sequence
ctggccgtgggcctgca

SEQ ID NO: 3149 - DNA, 17 bp, Artificial sequence
  Synthesized sequence
atggcagagggcgagca

SEQ ID NO: 3150 - DNA, 17 bp, Artificial sequence
  Synthesized sequence
ctggtgcataccctgca

SEQ ID NO: 3151 - DNA, 17 bp, Artificial sequence
  Synthesized sequence
ctggcgcggattccgcg

SEQ ID NO: 3152 - DNA, 17 bp, Artificial sequence
  Synthesized sequence
caggccgaaggtttgca

SEQ ID NO: 3153 - DNA, 17 bp, Artificial sequence
  Synthesized sequence
ctggcccgcgccgttca

SEQ ID NO: 3154 - DNA, 17 bp, Artificial sequence
  Synthesized sequence
atcgccgaccgcttgct

SEQ ID NO: 3155 - DNA, 17 bp, Artificial sequence
  Synthesized sequence
gtcgcacgcttgacgct

SEQ ID NO: 3156 - DNA, 17 bp, Artificial sequence
  Synthesized sequence
gtggcatccgaccggca

SEQ ID NO: 3157 - DNA, 17 bp, Artificial sequence
  Synthesized sequence
cgggcgctgctgatgct

SEQ ID NO: 3158 - DNA, 17 bp, Artificial sequence
  Synthesized sequence
tcggcaggcgcttttct

SEQ ID NO: 3159 - DNA, 17 bp, Artificial sequence
  Synthesized sequence
ctggtagccgagctgct

SEQ ID NO: 3160 - DNA, 17 bp, Artificial sequence
  Synthesized sequence
ctggtacagcgagcgca

SEQ ID NO: 3161 - DNA, 17 bp, Artificial sequence
  Synthesized sequence
ttggcccaggtctgggt

SEQ ID NO: 3162 - DNA, 17 bp, Artificial sequence
  Synthesized sequence
ctggcggagcccatgcg

SEQ ID NO: 3163 - DNA, 17 bp, Artificial sequence
  Synthesized sequence
atggcaggcgcaataca

SEQ ID NO: 3164 - DNA, 17 bp, Artificial sequence
  Synthesized sequence
atggcaggcgcaataca

SEQ ID NO: 3165 - DNA, 17 bp, Artificial sequence
  Synthesized sequence
gtgggtcagccagtgca

SEQ ID NO: 3166 - DNA, 17 bp, Artificial sequence
  Synthesized sequence
ctggcctggcacctgaa

SEQ ID NO: 3167 - DNA, 17 bp, Artificial sequence
  Synthesized sequence
ctggcgatccaggtgct

SEQ ID NO: 3168 - DNA, 17 bp, Artificial sequence
  Synthesized sequence
ttcgcgcgcttggtgca

SEQ ID NO: 3169 - DNA, 17 bp, Artificial sequence
  Synthesized sequence
atggcccgcgcctcgat

SEQ ID NO: 3170 - DNA, 17 bp, Artificial sequence
  Synthesized sequence
gtcgcttccctgttgca

SEQ ID NO: 3171 - DNA, 17 bp, Artificial sequence
  Synthesized sequence
gtcgcttccctgttgca

SEQ ID NO: 3172 - DNA, 17 bp, Artificial sequence
  Synthesized sequence
ctggccgaacgtttcct

SEQ ID NO: 3173 - DNA, 17 bp, Artificial sequence
  Synthesized sequence
gcggcaggccgatttca

SEQ ID NO: 3174 - DNA, 17 bp, Artificial sequence
  Synthesized sequence
gcggcactgacctcgcc

SEQ ID NO: 3175 - DNA, 17 bp, Artificial sequence
  Synthesized sequence
tcggcatgcccttggcc

SEQ ID NO: 3176 - DNA, 17 bp, Artificial sequence
  Synthesized sequence
ccgccacgtctgctgct

SEQ ID NO: 3177 - DNA, 17 bp, Artificial sequence
  Synthesized sequence
ctggcgatcaccgtgca

SEQ ID NO: 3178 - DNA, 17 bp, Artificial sequence
  Synthesized sequence
ctgccacggcggacgct

SEQ ID NO: 3179 - DNA, 17 bp, Artificial sequence
  Synthesized sequence
ctggaacaggtgctggt

SEQ ID NO: 3180 - DNA, 17 bp, Artificial sequence
  Synthesized sequence
gtggaagcgacctcgct

SEQ ID NO: 3181 - DNA, 17 bp, Artificial sequence
  Synthesized sequence
ctggcacctctggcgcc

SEQ ID NO: 3182 - DNA, 17 bp, Artificial sequence
  Synthesized sequence
ccgcaacggcagttgca

SEQ ID NO: 3183 - DNA, 17 bp, Artificial sequence
  Synthesized sequence
tgggcagactggctgct

SEQ ID NO: 3184 - DNA, 17 bp, Artificial sequence
  Synthesized sequence
ctggcgcccaagtggcg

SEQ ID NO: 3185 - DNA, 17 bp, Artificial sequence
  Synthesized sequence
atggttccgatgctgca

SEQ ID NO: 3186 - DNA, 17 bp, Artificial sequence
  Synthesized sequence
gtggcaagttcctggaa

SEQ ID NO: 3187 - DNA, 17 bp, Artificial sequence
  Synthesized sequence
tgggcactttttatgcc

SEQ ID NO: 3188 - DNA, 17 bp, Artificial sequence
  Synthesized sequence
tgggcactttttatgcc

SEQ ID NO: 3189 - DNA, 17 bp, Artificial sequence
  Synthesized sequence
ccgggacgttccgtgca

SEQ ID NO: 3190 - DNA, 17 bp, Artificial sequence
  Synthesized sequence
ctgggattgccattcca

SEQ ID NO: 3191 - DNA, 17 bp, Artificial sequence
  Synthesized sequence
tcggcaccctgctggcc

SEQ ID NO: 3192 - DNA, 17 bp, Artificial sequence
  Synthesized sequence
gcggcaagccactggcc

SEQ ID NO: 3193 - DNA, 17 bp, Artificial sequence
  Synthesized sequence
gtggaatccggttcgca

SEQ ID NO: 3194 - DNA, 17 bp, Artificial sequence
  Synthesized sequence
ttggcgagggcttcgcc

SEQ ID NO: 3195 - DNA, 17 bp, Artificial sequence
  Synthesized sequence
gtggcgaacacgttcca

SEQ ID NO: 3196 - DNA, 17 bp, Artificial sequence
  Synthesized sequence
ctgccgcaggacctgct

SEQ ID NO: 3197 - DNA, 17 bp, Artificial sequence
  Synthesized sequence
ctggccatccgctggca

SEQ ID NO: 3198 - DNA, 17 bp, Artificial sequence
  Synthesized sequence
ttggcacgcagccgcca

SEQ ID NO: 3199 - DNA, 17 bp, Artificial sequence
  Synthesized sequence
atggctcggtttacgcc

SEQ ID NO: 3200 - DNA, 17 bp, Artificial sequence
  Synthesized sequence
gcggcgccgccgctgct

SEQ ID NO: 3201 - DNA, 17 bp, Artificial sequence
  Synthesized sequence
tgtgcacaagcattgcg

SEQ ID NO: 3202 - DNA, 17 bp, Artificial sequence
  Synthesized sequence
gtggcaggtcgctgcca

SEQ ID NO: 3203 - DNA, 17 bp, Artificial sequence
  Synthesized sequence
ctggccaggggctggcc

SEQ ID NO: 3204 - DNA, 17 bp, Artificial sequence
  Synthesized sequence
gtcggagcgttgttgct

SEQ ID NO: 3205 - DNA, 17 bp, Artificial sequence
  Synthesized sequence
ctgtcgtagaccttgcg

SEQ ID NO: 3206 - DNA, 17 bp, Artificial sequence
  Synthesized sequence
caggccctgtacctgca

SEQ ID NO: 3207 - DNA, 17 bp, Artificial sequence
  Synthesized sequence
ctgggccacccgtggct

SEQ ID NO: 3208 - DNA, 17 bp, Artificial sequence
  Synthesized sequence
tttgcagaagccgtgca

SEQ ID NO: 3209 - DNA, 17 bp, Artificial sequence
  Synthesized sequence
ctgggacagtaccttca

SEQ ID NO: 3210 - DNA, 17 bp, Artificial sequence
  Synthesized sequence
ctggagcaactggtgcg

SEQ ID NO: 3211 - DNA, 17 bp, Artificial sequence
  Synthesized sequence
ctggcaggccggacgcc

SEQ ID NO: 3212 - DNA, 17 bp, Artificial sequence
  Synthesized sequence
ttggaaggcgtcttccg

SEQ ID NO: 3213 - DNA, 17 bp, Artificial sequence
  Synthesized sequence
ctggtatgcatgcagca

SEQ ID NO: 3214 - DNA, 17 bp, Artificial sequence
  Synthesized sequence
ctggcgccgttgccgca

SEQ ID NO: 3215 - DNA, 17 bp, Artificial sequence
  Synthesized sequence
tcgacatgggccttgcg

SEQ ID NO: 3216 - DNA, 17 bp, Artificial sequence
  Synthesized sequence
ctggacgcgctgttgcg

SEQ ID NO: 3217 - DNA, 17 bp, Artificial sequence
  Synthesized sequence
ctggacgcgctgttgcg

SEQ ID NO: 3218 - DNA, 17 bp, Artificial sequence
  Synthesized sequence
ccggcacgattgttcgt

SEQ ID NO: 3219 - DNA, 17 bp, Artificial sequence
  Synthesized sequence
gtgtcatataacttgat

SEQ ID NO: 3220 - DNA, 17 bp, Artificial sequence
  Synthesized sequence
ttggtacggcgaaagcg

SEQ ID NO: 3221 - DNA, 17 bp, Artificial sequence
  Synthesized sequence
atggcgcggagcgggcg

SEQ ID NO: 3222 - DNA, 17 bp, Artificial sequence
  Synthesized sequence
gtggctgtatttttgtt

SEQ ID NO: 3223 - DNA, 17 bp, Artificial sequence
  Synthesized sequence
atcgaacggctggtgcg

SEQ ID NO: 3224 - DNA, 17 bp, Artificial sequence
  Synthesized sequence
tcggcaaggaactggcc

SEQ ID NO: 3225 - DNA, 17 bp, Artificial sequence
  Synthesized sequence
aaggaacgatccatgcg

SEQ ID NO: 3226 - DNA, 17 bp, Artificial sequence
  Synthesized sequence
tcggccagcggcttgcc

SEQ ID NO: 3227 - DNA, 17 bp, Artificial sequence
  Synthesized sequence
cttgcgcgacacttcca

SEQ ID NO: 3228 - DNA, 17 bp, Artificial sequence
  Synthesized sequence
taggcgcaaccgttgat

SEQ ID NO: 3229 - DNA, 17 bp, Artificial sequence
  Synthesized sequence
ttggcatgcatgttcac

SEQ ID NO: 3230 - DNA, 17 bp, Artificial sequence
  Synthesized sequence
ctggcgcgcgcctacct

SEQ ID NO: 3231 - DNA, 17 bp, Artificial sequence
  Synthesized sequence
ctggtccgcggcctgcg

SEQ ID NO: 3232 - DNA, 17 bp, Artificial sequence
  Synthesized sequence
gtgggatgtcaatagcc

SEQ ID NO: 3233 - DNA, 17 bp, Artificial sequence
  Synthesized sequence
ctggcgcgcaagtgcct

SEQ ID NO: 3234 - DNA, 17 bp, Artificial sequence
  Synthesized sequence
ctgccatgggcgctgcg

SEQ ID NO: 3235 - DNA, 17 bp, Artificial sequence
  Synthesized sequence
ctggggctcagcctgct

SEQ ID NO: 3236 - DNA, 17 bp, Artificial sequence
  Synthesized sequence
atggaacaatgcgggca

SEQ ID NO: 3237 - DNA, 17 bp, Artificial sequence
  Synthesized sequence
ctggccccgcgccttct

SEQ ID NO: 3238 - DNA, 17 bp, Artificial sequence
  Synthesized sequence
aaggggccgctgttgca

SEQ ID NO: 3239 - DNA, 17 bp, Artificial sequence
  Synthesized sequence
aaggcgcgctacctgcg

SEQ ID NO: 3240 - DNA, 17 bp, Artificial sequence
  Synthesized sequence
atgggccacagttcgct

SEQ ID NO: 3241 - DNA, 17 bp, Artificial sequence
  Synthesized sequence
ctggcgcggctctcccc

SEQ ID NO: 3242 - DNA, 17 bp, Artificial sequence
  Synthesized sequence
ctgccgcagacgctgct

SEQ ID NO: 3243 - DNA, 17 bp, Artificial sequence
  Synthesized sequence
taggctcgggttgtgcg

SEQ ID NO: 3244 - DNA, 17 bp, Artificial sequence
  Synthesized sequence
tcggcacggcgtttcgt

SEQ ID NO: 3245 - DNA, 17 bp, Artificial sequence
  Synthesized sequence
ctggcggtggacttcct

SEQ ID NO: 3246 - DNA, 17 bp, Artificial sequence
  Synthesized sequence
gtggtccgctgcatgcc

SEQ ID NO: 3247 - DNA, 17 bp, Artificial sequence
  Synthesized sequence
ctggcacttcatcggcc

SEQ ID NO: 3248 - DNA, 17 bp, Artificial sequence
  Synthesized sequence
ctggcgcggcgtccgcc

SEQ ID NO: 3249 - DNA, 17 bp, Artificial sequence
  Synthesized sequence
tcggcccggccgatgcg

SEQ ID NO: 3250 - DNA, 17 bp, Artificial sequence
  Synthesized sequence
atggcgagcgagatgcg

SEQ ID NO: 3251 - DNA, 17 bp, Artificial sequence
  Synthesized sequence
ctggcaggagcgccgcg

SEQ ID NO: 3252 - DNA, 17 bp, Artificial sequence
  Synthesized sequence
ctggccattgccctgct

SEQ ID NO: 3253 - DNA, 17 bp, Artificial sequence
  Synthesized sequence
caggcaaaatacttaca

SEQ ID NO: 3254 - DNA, 17 bp, Artificial sequence
  Synthesized sequence
ggggcaggcgccatgcg

SEQ ID NO: 3255 - DNA, 17 bp, Artificial sequence
  Synthesized sequence
atcgcccagggcctgct

SEQ ID NO: 3256 - DNA, 17 bp, Artificial sequence
  Synthesized sequence
gcggcatgcgcttcgcc

SEQ ID NO: 3257 - DNA, 17 bp, Artificial sequence
  Synthesized sequence
ttggccaaaccgctgcc

SEQ ID NO: 3258 - DNA, 17 bp, Artificial sequence
  Synthesized sequence
acggcatgggcgtggcc

SEQ ID NO: 3259 - DNA, 17 bp, Artificial sequence
  Synthesized sequence
atgggaggactcctgtt

SEQ ID NO: 3260 - DNA, 17 bp, Artificial sequence
  Synthesized sequence
gcggcaccgttccggca

SEQ ID NO: 3261 - DNA, 17 bp, Artificial sequence
  Synthesized sequence
gaggcacaacgcctggt

SEQ ID NO: 3262 - DNA, 17 bp, Artificial sequence
  Synthesized sequence
gacggacgccaattgca

SEQ ID NO: 3263 - DNA, 17 bp, Artificial sequence
  Synthesized sequence
ctggcgcgacgctacca

SEQ ID NO: 3264 - DNA, 17 bp, Artificial sequence
  Synthesized sequence
ctggcgcgtggcaagca

SEQ ID NO: 3265 - DNA, 17 bp, Artificial sequence
  Synthesized sequence
ccggcaccctgctcgcc

SEQ ID NO: 3266 - DNA, 17 bp, Artificial sequence
  Synthesized sequence
cgagcacgacactttct

SEQ ID NO: 3267 - DNA, 17 bp, Artificial sequence
  Synthesized sequence
acggcaccaggctggcg

SEQ ID NO: 3268 - DNA, 17 bp, Artificial sequence
  Synthesized sequence
ctggcggatctgctgcg

SEQ ID NO: 3269 - DNA, 17 bp, Artificial sequence
  Synthesized sequence
ctggcgctgttcgtgtt

SEQ ID NO: 3270 - DNA, 17 bp, Artificial sequence
  Synthesized sequence
gtggggcgcctttggcg

SEQ ID NO: 3271 - DNA, 17 bp, Artificial sequence
  Synthesized sequence
ccggcacaaccagggct

SEQ ID NO: 3272 - DNA, 17 bp, Artificial sequence
  Synthesized sequence
ctggcgcaggccgtggt

SEQ ID NO: 3273 - DNA, 17 bp, Artificial sequence
  Synthesized sequence
atggaatggtttctgaa

SEQ ID NO: 3274 - DNA, 17 bp, Artificial sequence
  Synthesized sequence
atggcacaggtcagtca

SEQ ID NO: 3275 - DNA, 17 bp, Artificial sequence
  Synthesized sequence
gcggccttgcgcttgcg

SEQ ID NO: 3276 - DNA, 17 bp, Artificial sequence
  Synthesized sequence
gtcgcaggacgtttcca

SEQ ID NO: 3277 - DNA, 17 bp, Artificial sequence
  Synthesized sequence
ttcgcccgggaatcgca

SEQ ID NO: 3278 - DNA, 17 bp, Artificial sequence
  Synthesized sequence
ccggcatgcaggtggcg

SEQ ID NO: 3279 - DNA, 17 bp, Artificial sequence
  Synthesized sequence
tcggtacggtcgctgcg

SEQ ID NO: 3280 - DNA, 17 bp, Artificial sequence
  Synthesized sequence
ctggagcagcgtttcca

SEQ ID NO: 3281 - DNA, 17 bp, Artificial sequence
  Synthesized sequence
ccgcgacggcggttgca

SEQ ID NO: 3282 - DNA, 17 bp, Artificial sequence
  Synthesized sequence
ccgggtcagcgattgca

SEQ ID NO: 3283 - DNA, 17 bp, Artificial sequence
  Synthesized sequence
tacgcattgcctttgct

SEQ ID NO: 3284 - DNA, 17 bp, Artificial sequence
  Synthesized sequence
ttggtacaggagctgta

SEQ ID NO: 3285 - DNA, 17 bp, Artificial sequence
  Synthesized sequence
cagggccacgagttgct

SEQ ID NO: 3286 - DNA, 17 bp, Artificial sequence
  Synthesized sequence
gtcgggcagaaattgct

SEQ ID NO: 3287 - DNA, 17 bp, Artificial sequence
  Synthesized sequence
ctgggatggtggtttcc

SEQ ID NO: 3288 - DNA, 17 bp, Artificial sequence
  Synthesized sequence
ctgaccatcctgttgct

SEQ ID NO: 3289 - DNA, 17 bp, Artificial sequence
  Synthesized sequence
ttgccctgaacattgcc

SEQ ID NO: 3290 - DNA, 17 bp, Artificial sequence
  Synthesized sequence
ccggcaaagcggtttca

SEQ ID NO: 3291 - DNA, 17 bp, Artificial sequence
  Synthesized sequence
ccggcaccagcctagcg

SEQ ID NO: 3292 - DNA, 17 bp, Artificial sequence
  Synthesized sequence
gtggtgcccaaggtgct

SEQ ID NO: 3293 - DNA, 17 bp, Artificial sequence
  Synthesized sequence
ctggacctggagctgct

SEQ ID NO: 3294 - DNA, 17 bp, Artificial sequence
  Synthesized sequence
ccggcagccctatggct

SEQ ID NO: 3295 - DNA, 17 bp, Artificial sequence
  Synthesized sequence
ctgggctacctgctgct

SEQ ID NO: 3296 - DNA, 17 bp, Artificial sequence
  Synthesized sequence
aaggctcgcgcatggct

SEQ ID NO: 3297 - DNA, 17 bp, Artificial sequence
  Synthesized sequence
gcgggaagccggttgcg

SEQ ID NO: 3298 - DNA, 17 bp, Artificial sequence
  Synthesized sequence
ctggcgtagggtctgcc

SEQ ID NO: 3299 - DNA, 17 bp, Artificial sequence
  Synthesized sequence
tcggcaagccgctggcg

SEQ ID NO: 3300 - DNA, 17 bp, Artificial sequence
  Synthesized sequence
ccggcaccctgctggcc

SEQ ID NO: 3301 - DNA, 17 bp, Artificial sequence
  Synthesized sequence
atggagcagaacctgcg

SEQ ID NO: 3302 - DNA, 17 bp, Artificial sequence
  Synthesized sequence
gtggtcagggtggtgct

SEQ ID NO: 3303 - DNA, 17 bp, Artificial sequence
  Synthesized sequence
ctggcaaagcctttcga

SEQ ID NO: 3304 - DNA, 17 bp, Artificial sequence
  Synthesized sequence
cgggaacaggcggtgct

SEQ ID NO: 3305 - DNA, 17 bp, Artificial sequence
  Synthesized sequence
atggcgatggcctggca

SEQ ID NO: 3306 - DNA, 17 bp, Artificial sequence
  Synthesized sequence
gcggcctggctattggt

SEQ ID NO: 3307 - DNA, 17 bp, Artificial sequence
  Synthesized sequence
gtggccaaggccctgcc

SEQ ID NO: 3308 - DNA, 17 bp, Artificial sequence
  Synthesized sequence
tcggcaaggccttcgcc

SEQ ID NO: 3309 - DNA, 17 bp, Artificial sequence
  Synthesized sequence
ttcgaatggcgcctgct

SEQ ID NO: 3310 - DNA, 17 bp, Artificial sequence
  Synthesized sequence
aagaaacgggagttgca

SEQ ID NO: 3311 - DNA, 17 bp, Artificial sequence
  Synthesized sequence
cctgaacaactattgct

SEQ ID NO: 3312 - DNA, 17 bp, Artificial sequence
  Synthesized sequence
atggaaggctgggtgcg

SEQ ID NO: 3313 - DNA, 17 bp, Artificial sequence
  Synthesized sequence
tcggcgcggatctcgcc

SEQ ID NO: 3314 - DNA, 17 bp, Artificial sequence
  Synthesized sequence
ctggcgcaggcgcggca

SEQ ID NO: 3315 - DNA, 17 bp, Artificial sequence
  Synthesized sequence
ctggcgcgcctgctggg

SEQ ID NO: 3316 - DNA, 17 bp, Artificial sequence
  Synthesized sequence
atcgcccggccgttgga

SEQ ID NO: 3317 - DNA, 17 bp, Artificial sequence
  Synthesized sequence
ctggctggcactctgcc

SEQ ID NO: 3318 - DNA, 17 bp, Artificial sequence
  Synthesized sequence
ctggtacggtccctggg

SEQ ID NO: 3319 - DNA, 17 bp, Artificial sequence
  Synthesized sequence
ctggagcgaccgctgcc

SEQ ID NO: 3320 - DNA, 17 bp, Artificial sequence
  Synthesized sequence
ctggcgcaggttgtcca

SEQ ID NO: 3321 - DNA, 17 bp, Artificial sequence
  Synthesized sequence
gtggaatgatatttccc

SEQ ID NO: 3322 - DNA, 17 bp, Artificial sequence
  Synthesized sequence
atggcgcgcttgccgcg

SEQ ID NO: 3323 - DNA, 17 bp, Artificial sequence
  Synthesized sequence
ccggcgcggccctggcg

SEQ ID NO: 3324 - DNA, 17 bp, Artificial sequence
  Synthesized sequence
cgggcacaccagccgca

SEQ ID NO: 3325 - DNA, 17 bp, Artificial sequence
  Synthesized sequence
ctggaagtcggcatgca

SEQ ID NO: 3326 - DNA, 17 bp, Artificial sequence
  Synthesized sequence
cagccagggttcttgcc

SEQ ID NO: 3327 - DNA, 17 bp, Artificial sequence
  Synthesized sequence
atggccgagctgtcgcc

SEQ ID NO: 3328 - DNA, 17 bp, Artificial sequence
  Synthesized sequence
ctggtacgacctcagcg

SEQ ID NO: 3329 - DNA, 17 bp, Artificial sequence
  Synthesized sequence
ctgcgccagcccttgca

SEQ ID NO: 3330 - DNA, 17 bp, Artificial sequence
  Synthesized sequence
ttggcatgcagctcggc

SEQ ID NO: 3331 - DNA, 17 bp, Artificial sequence
  Synthesized sequence
tgggcatgggcttcgcc

SEQ ID NO: 3332 - DNA, 17 bp, Artificial sequence
  Synthesized sequence
acggcattcccatggca

SEQ ID NO: 3333 - DNA, 17 bp, Artificial sequence
  Synthesized sequence
atcgcgccagccttgcc

SEQ ID NO: 3334 - DNA, 17 bp, Artificial sequence
  Synthesized sequence
gtcgcaaggccctcgcc

SEQ ID NO: 3335 - DNA, 17 bp, Artificial sequence
  Synthesized sequence
atggcagaaattccgcg

SEQ ID NO: 3336 - DNA, 17 bp, Artificial sequence
  Synthesized sequence
ggcgcacagccgctgct

SEQ ID NO: 3337 - DNA, 17 bp, Artificial sequence
  Synthesized sequence
atgggtcaggtcttcca

SEQ ID NO: 3338 - DNA, 17 bp, Artificial sequence
  Synthesized sequence
gtcgcaaggccctggcg

SEQ ID NO: 3339 - DNA, 17 bp, Artificial sequence
  Synthesized sequence
ttggcccggcatgggcg

SEQ ID NO: 3340 - DNA, 17 bp, Artificial sequence
  Synthesized sequence
ttggcgcaggaagggca

SEQ ID NO: 3341 - DNA, 17 bp, Artificial sequence
  Synthesized sequence
ctggtgcgcgccctgcc

SEQ ID NO: 3342 - DNA, 17 bp, Artificial sequence
  Synthesized sequence
ctggcgccgccccagct

SEQ ID NO: 3343 - DNA, 17 bp, Artificial sequence
  Synthesized sequence
gtcgccgccctattgct

SEQ ID NO: 3344 - DNA, 17 bp, Artificial sequence
  Synthesized sequence
atggcgttctcctttca

SEQ ID NO: 3345 - DNA, 17 bp, Artificial sequence
  Synthesized sequence
ggggtacgcttgatgcg

SEQ ID NO: 3346 - DNA, 17 bp, Artificial sequence
  Synthesized sequence
ttggcaagaagaccgcc

SEQ ID NO: 3347 - DNA, 17 bp, Artificial sequence
  Synthesized sequence
gtggccgacaacctgcc

SEQ ID NO: 3348 - DNA, 17 bp, Artificial sequence
  Synthesized sequence
gaggcaggaaggctgcg

SEQ ID NO: 3349 - DNA, 17 bp, Artificial sequence
  Synthesized sequence
gaggcaggaaggctgcg

SEQ ID NO: 3350 - DNA, 17 bp, Artificial sequence
  Synthesized sequence
ctggcagccgctttccc

SEQ ID NO: 3351 - DNA, 17 bp, Artificial sequence
  Synthesized sequence
ttggcaaagctctagag

SEQ ID NO: 3352 - DNA, 17 bp, Artificial sequence
  Synthesized sequence
ccgttacaacccttgct

SEQ ID NO: 3353 - DNA, 17 bp, Artificial sequence
  Synthesized sequence
ctggccggggacttccc

SEQ ID NO: 3354 - DNA, 17 bp, Artificial sequence
  Synthesized sequence
ctggcgtcgcaactgcg

SEQ ID NO: 3355 - DNA, 17 bp, Artificial sequence
  Synthesized sequence
ccggtgctgaccttgca

SEQ ID NO: 3356 - DNA, 17 bp, Artificial sequence
  Synthesized sequence
ttggcgtaagcgatgcg

SEQ ID NO: 3357 - DNA, 17 bp, Artificial sequence
  Synthesized sequence
gcgggagagcgcttgcg

SEQ ID NO: 3358 - DNA, 17 bp, Artificial sequence
  Synthesized sequence
caggccatccagttgca

SEQ ID NO: 3359 - DNA, 17 bp, Artificial sequence
  Synthesized sequence
atgaccaaggcgttgct

SEQ ID NO: 3360 - DNA, 17 bp, Artificial sequence
  Synthesized sequence
gtggcacgaccctctgt

SEQ ID NO: 3361 - DNA, 17 bp, Artificial sequence
  Synthesized sequence
tgggcaaggcgttcgcc

SEQ ID NO: 3362 - DNA, 17 bp, Artificial sequence
  Synthesized sequence
ctggctctgctgctggt

SEQ ID NO: 3363 - DNA, 17 bp, Artificial sequence
  Synthesized sequence
ttggcgcgccaccagcc

SEQ ID NO: 3364 - DNA, 17 bp, Artificial sequence
  Synthesized sequence
gcggcatcgaggttgtt

SEQ ID NO: 3365 - DNA, 17 bp, Artificial sequence
  Synthesized sequence
cccgctcgacgattgct

SEQ ID NO: 3366 - DNA, 17 bp, Artificial sequence
  Synthesized sequence
atggcctagtgctggcg

SEQ ID NO: 3367 - DNA, 17 bp, Artificial sequence
  Synthesized sequence
ttggggccgtatgtgct

SEQ ID NO: 3368 - DNA, 17 bp, Artificial sequence
  Synthesized sequence
ggggcagggcgcttggc

SEQ ID NO: 3369 - DNA, 17 bp, Artificial sequence
  Synthesized sequence
ctggagcgccaggtgcg

SEQ ID NO: 3370 - DNA, 17 bp, Artificial sequence
  Synthesized sequence
atcgcccggctctggcg

SEQ ID NO: 3371 - DNA, 17 bp, Artificial sequence
  Synthesized sequence
atcgccctgctggtgct

SEQ ID NO: 3372 - DNA, 17 bp, Artificial sequence
  Synthesized sequence
ctggcccgacgcctggg

SEQ ID NO: 3373 - DNA, 17 bp, Artificial sequence
  Synthesized sequence
ccggcaccggcatcgcc

SEQ ID NO: 3374 - DNA, 17 bp, Artificial sequence
  Synthesized sequence
atggggctgacctcgct

SEQ ID NO: 3375 - DNA, 17 bp, Artificial sequence
  Synthesized sequence
gtggccgaggtgctgcc

SEQ ID NO: 3376 - DNA, 17 bp, Artificial sequence
  Synthesized sequence
ctggtagagaagatgcg

SEQ ID NO: 3377 - DNA, 17 bp, Artificial sequence
  Synthesized sequence
ctggtacaggattcggt

SEQ ID NO: 3378 - DNA, 17 bp, Artificial sequence
  Synthesized sequence
taggctcggggttcgca

SEQ ID NO: 3379 - DNA, 17 bp, Artificial sequence
  Synthesized sequence
atggcccgcatcgagcg

SEQ ID NO: 3380 - DNA, 17 bp, Artificial sequence
  Synthesized sequence
ctggtctgcgcgctgct

SEQ ID NO: 3381 - DNA, 17 bp, Artificial sequence
  Synthesized sequence
ctgccatggcccttgac

SEQ ID NO: 3382 - DNA, 17 bp, Artificial sequence
  Synthesized sequence
tggggaaccttgttgca

SEQ ID NO: 3383 - DNA, 17 bp, Artificial sequence
  Synthesized sequence
gcggcatgctcctggcc

SEQ ID NO: 3384 - DNA, 17 bp, Artificial sequence
  Synthesized sequence
ttgccaggacgcctgcg

SEQ ID NO: 3385 - DNA, 17 bp, Artificial sequence
  Synthesized sequence
ttgccaggacgcctgcg

SEQ ID NO: 3386 - DNA, 17 bp, Artificial sequence
  Synthesized sequence
atggcggcgtccttgtt

SEQ ID NO: 3387 - DNA, 17 bp, Artificial sequence
  Synthesized sequence
atggggcaagactagca

SEQ ID NO: 3388 - DNA, 17 bp, Artificial sequence
  Synthesized sequence
ccggcaaggtcctggcg

SEQ ID NO: 3389 - DNA, 17 bp, Artificial sequence
  Synthesized sequence
ttggcgtgaagtttccg

SEQ ID NO: 3390 - DNA, 17 bp, Artificial sequence
  Synthesized sequence
ccggcccgctacgtgcg

SEQ ID NO: 3391 - DNA, 17 bp, Artificial sequence
  Synthesized sequence
ctggcccttgcgatgcc

SEQ ID NO: 3392 - DNA, 17 bp, Artificial sequence
  Synthesized sequence
ctggcccttgcgatgcc

SEQ ID NO: 3393 - DNA, 17 bp, Artificial sequence
  Synthesized sequence
ctggtgccctgcatgct

SEQ ID NO: 3394 - DNA, 17 bp, Artificial sequence
  Synthesized sequence
cgggcaccacatttccc

SEQ ID NO: 3395 - DNA, 17 bp, Artificial sequence
  Synthesized sequence
ctggcacgggccctcga

SEQ ID NO: 3396 - DNA, 17 bp, Artificial sequence
  Synthesized sequence
ccagcaggtgccttgca

SEQ ID NO: 3397 - DNA, 17 bp, Artificial sequence
  Synthesized sequence
gtggtacaaatttgcct

SEQ ID NO: 3398 - DNA, 17 bp, Artificial sequence
  Synthesized sequence
ccggcaaggtgctcgcg

SEQ ID NO: 3399 - DNA, 17 bp, Artificial sequence
  Synthesized sequence
gtcgccgcgcaattgct

SEQ ID NO: 3400 - DNA, 17 bp, Artificial sequence
  Synthesized sequence
ctggctggccagtcgcg

SEQ ID NO: 3401 - DNA, 17 bp, Artificial sequence
  Synthesized sequence
atgggctgggtatcgct

SEQ ID NO: 3402 - DNA, 17 bp, Artificial sequence
  Synthesized sequence
gtggcgaagccctggcg

SEQ ID NO: 3403 - DNA, 17 bp, Artificial sequence
  Synthesized sequence
gtggcgcagttttccct

SEQ ID NO: 3404 - DNA, 17 bp, Artificial sequence
  Synthesized sequence
atggggctgctgtggct

SEQ ID NO: 3405 - DNA, 17 bp, Artificial sequence
  Synthesized sequence
ctgccgcgcatgttcct

SEQ ID NO: 3406 - DNA, 17 bp, Artificial sequence
  Synthesized sequence
atcgagcaacagttgct

SEQ ID NO: 3407 - DNA, 17 bp, Artificial sequence
  Synthesized sequence
ctggccctggtggcgct

SEQ ID NO: 3408 - DNA, 17 bp, Artificial sequence
  Synthesized sequence
ctggcttatggctggca

SEQ ID NO: 3409 - DNA, 17 bp, Artificial sequence
  Synthesized sequence
ttcgccaggcgcttgcc

SEQ ID NO: 3410 - DNA, 17 bp, Artificial sequence
  Synthesized sequence
ctgcaacgccgggtgca

SEQ ID NO: 3411 - DNA, 17 bp, Artificial sequence
  Synthesized sequence
ctggaggcggcgttgca

SEQ ID NO: 3412 - DNA, 17 bp, Artificial sequence
  Synthesized sequence
ttggcatgggcgtcgac

SEQ ID NO: 3413 - DNA, 17 bp, Artificial sequence
  Synthesized sequence
gtgcaccaccagttgct

SEQ ID NO: 3414 - DNA, 17 bp, Artificial sequence
  Synthesized sequence
atgaccccgctgctgct

SEQ ID NO: 3415 - DNA, 17 bp, Artificial sequence
  Synthesized sequence
gttgcagggctatcgcg

SEQ ID NO: 3416 - DNA, 17 bp, Artificial sequence
  Synthesized sequence
ctgcgacgcacctcgca

SEQ ID NO: 3417 - DNA, 17 bp, Artificial sequence
  Synthesized sequence
gaggctcacaaagtgct

SEQ ID NO: 3418 - DNA, 17 bp, Artificial sequence
  Synthesized sequence
tcggcgaaggtcttgcg

SEQ ID NO: 3419 - DNA, 17 bp, Artificial sequence
  Synthesized sequence
tcggcatgggcgtcgcc

SEQ ID NO: 3420 - DNA, 17 bp, Artificial sequence
  Synthesized sequence
cgcgcccgcgagttgct

SEQ ID NO: 3421 - DNA, 17 bp, Artificial sequence
  Synthesized sequence
tcggcccattttctgca

SEQ ID NO: 3422 - DNA, 17 bp, Artificial sequence
  Synthesized sequence
actgcacggccatggct

SEQ ID NO: 3423 - DNA, 17 bp, Artificial sequence
  Synthesized sequence
gtcgcgcaagggttgcc

SEQ ID NO: 3424 - DNA, 17 bp, Artificial sequence
  Synthesized sequence
atggcgcgctcctggga

SEQ ID NO: 3425 - DNA, 17 bp, Artificial sequence
  Synthesized sequence
gcggcaccctgctggcc

SEQ ID NO: 3426 - DNA, 17 bp, Artificial sequence
  Synthesized sequence
ctggcggtcggcctgct

SEQ ID NO: 3427 - DNA, 17 bp, Artificial sequence
  Synthesized sequence
atggcgaggagtttgtc

SEQ ID NO: 3428 - DNA, 17 bp, Artificial sequence
  Synthesized sequence
ctggcgcgagcggtgta

SEQ ID NO: 3429 - DNA, 17 bp, Artificial sequence
  Synthesized sequence
gaggcactggcgtcgcc

SEQ ID NO: 3430 - DNA, 17 bp, Artificial sequence
  Synthesized sequence
atggcccacagcccgca

SEQ ID NO: 3431 - DNA, 17 bp, Artificial sequence
  Synthesized sequence
acggcgctgccgatgct

SEQ ID NO: 3432 - DNA, 17 bp, Artificial sequence
  Synthesized sequence
ccggcacggtcatcgaa

SEQ ID NO: 3433 - DNA, 17 bp, Artificial sequence
  Synthesized sequence
ctggcgcaaccgctgaa

SEQ ID NO: 3434 - DNA, 17 bp, Artificial sequence
  Synthesized sequence
attgctcggcagttgta

SEQ ID NO: 3435 - DNA, 17 bp, Artificial sequence
  Synthesized sequence
ctgtcacaccctttccg

SEQ ID NO: 3436 - DNA, 17 bp, Artificial sequence
  Synthesized sequence
ctggcgctgctgatcct

SEQ ID NO: 3437 - DNA, 17 bp, Artificial sequence
  Synthesized sequence
ccggaacagggtgtgca

SEQ ID NO: 3438 - DNA, 17 bp, Artificial sequence
  Synthesized sequence
gtgccgcagcggctgct

SEQ ID NO: 3439 - DNA, 17 bp, Artificial sequence
  Synthesized sequence
ctggccgggaccttccc

SEQ ID NO: 3440 - DNA, 17 bp, Artificial sequence
  Synthesized sequence
ttgtcatggtactggcg

SEQ ID NO: 3441 - DNA, 17 bp, Artificial sequence
  Synthesized sequence
gttgcagcgggattgcc

SEQ ID NO: 3442 - DNA, 17 bp, Artificial sequence
  Synthesized sequence
gtggcgctgcaaccgct

SEQ ID NO: 3443 - DNA, 17 bp, Artificial sequence
  Synthesized sequence
ctggcggtggcgctgca

SEQ ID NO: 3444 - DNA, 17 bp, Artificial sequence
  Synthesized sequence
ccggcgcgggtgctgcg

SEQ ID NO: 3445 - DNA, 17 bp, Artificial sequence
  Synthesized sequence
ctggccatcgttttgtt

SEQ ID NO: 3446 - DNA, 17 bp, Artificial sequence
  Synthesized sequence
ctggcgctcagatagcc

SEQ ID NO: 3447 - DNA, 17 bp, Artificial sequence
  Synthesized sequence
aaggaacgatccatgcg

SEQ ID NO: 3448 - DNA, 17 bp, Artificial sequence
  Synthesized sequence
atcgcccgccattggca

SEQ ID NO: 3449 - DNA, 17 bp, Artificial sequence
  Synthesized sequence
ctggtacaccggacgca

SEQ ID NO: 3450 - DNA, 17 bp, Artificial sequence
  Synthesized sequence
ctggccgcggagtggct

SEQ ID NO: 3451 - DNA, 17 bp, Artificial sequence
  Synthesized sequence
ctggacagcctggtgca

SEQ ID NO: 3452 - DNA, 17 bp, Artificial sequence
  Synthesized sequence
ctggacagcctggtgca

SEQ ID NO: 3453 - DNA, 17 bp, Artificial sequence
  Synthesized sequence
ttcgccgaagcgttgct

SEQ ID NO: 3454 - DNA, 17 bp, Artificial sequence
  Synthesized sequence
gtggcgccgatctcgat

SEQ ID NO: 3455 - DNA, 17 bp, Artificial sequence
  Synthesized sequence
atgatccagggcttgct

SEQ ID NO: 3456 - DNA, 17 bp, Artificial sequence
  Synthesized sequence
atgacggcgaccttgct

SEQ ID NO: 3457 - DNA, 17 bp, Artificial sequence
  Synthesized sequence
ccggcatgagcctggcc

SEQ ID NO: 3458 - DNA, 17 bp, Artificial sequence
  Synthesized sequence
ctggcagggatttcacc

SEQ ID NO: 3459 - DNA, 17 bp, Artificial sequence
  Synthesized sequence
ctggcagggttgattcc

SEQ ID NO: 3460 - DNA, 17 bp, Artificial sequence
  Synthesized sequence
gtcgatcagtacttgca

SEQ ID NO: 3461 - DNA, 17 bp, Artificial sequence
  Synthesized sequence
ctggcccgggcatggta

SEQ ID NO: 3462 - DNA, 17 bp, Artificial sequence
  Synthesized sequence
gaggcacgcgggatgat

SEQ ID NO: 3463 - DNA, 17 bp, Artificial sequence
  Synthesized sequence
caggcgctgcgcatgct

SEQ ID NO: 3464 - DNA, 17 bp, Artificial sequence
  Synthesized sequence
aaggccctgaccctgct

SEQ ID NO: 3465 - DNA, 17 bp, Artificial sequence
  Synthesized sequence
gtggcgcgtgactggat

SEQ ID NO: 3466 - DNA, 17 bp, Artificial sequence
  Synthesized sequence
ctgccccagcgcatgca

SEQ ID NO: 3467 - DNA, 17 bp, Artificial sequence
  Synthesized sequence
ttggccatacagtcgca

SEQ ID NO: 3468 - DNA, 17 bp, Artificial sequence
  Synthesized sequence
gcggtacaggtgttgaa

SEQ ID NO: 3469 - DNA, 17 bp, Artificial sequence
  Synthesized sequence
ctggcggtggggctgca

SEQ ID NO: 3470 - DNA, 17 bp, Artificial sequence
  Synthesized sequence
ctgaccgggcggttgcg

SEQ ID NO: 3471 - DNA, 17 bp, Artificial sequence
  Synthesized sequence
ctggcaggggctcagcg

SEQ ID NO: 3472 - DNA, 17 bp, Artificial sequence
  Synthesized sequence
gtggcgcgcctcgtccc

SEQ ID NO: 3473 - DNA, 17 bp, Artificial sequence
  Synthesized sequence
ctggccgcgagcttcct

SEQ ID NO: 3474 - DNA, 17 bp, Artificial sequence
  Synthesized sequence
ctgccgcagtacgtgct

SEQ ID NO: 3475 - DNA, 17 bp, Artificial sequence
  Synthesized sequence
aacgcgcgagccttgct

SEQ ID NO: 3476 - DNA, 17 bp, Artificial sequence
  Synthesized sequence
atcgtacggcgcctgcg

SEQ ID NO: 3477 - DNA, 17 bp, Artificial sequence
  Synthesized sequence
ctgccacgcctgatgga

SEQ ID NO: 3478 - DNA, 17 bp, Artificial sequence
  Synthesized sequence
atggcactcgacctggc

SEQ ID NO: 3479 - DNA, 17 bp, Artificial sequence
  Synthesized sequence
atggcactcgacctggc

SEQ ID NO: 3480 - DNA, 17 bp, Artificial sequence
  Synthesized sequence
atggccctgaacctgtt

SEQ ID NO: 3481 - DNA, 17 bp, Artificial sequence
  Synthesized sequence
atggccctgaacctgtt

SEQ ID NO: 3482 - DNA, 17 bp, Artificial sequence
  Synthesized sequence
cgcgcccaggtgttgct

SEQ ID NO: 3483 - DNA, 17 bp, Artificial sequence
  Synthesized sequence
acggcaaggtcctggcg

SEQ ID NO: 3484 - DNA, 17 bp, Artificial sequence
  Synthesized sequence
acggcaaggtcctggcg

SEQ ID NO: 3485 - DNA, 17 bp, Artificial sequence
  Synthesized sequence
gcggcacagccggcgca

SEQ ID NO: 3486 - DNA, 17 bp, Artificial sequence
  Synthesized sequence
atggccgtcgcgctgct

SEQ ID NO: 3487 - DNA, 17 bp, Artificial sequence
  Synthesized sequence
atagcccggtgctagca

SEQ ID NO: 3488 - DNA, 17 bp, Artificial sequence
  Synthesized sequence
atagcccggtgctagca

SEQ ID NO: 3489 - DNA, 17 bp, Artificial sequence
  Synthesized sequence
ctggtacttttgttccg

SEQ ID NO: 3490 - DNA, 17 bp, Artificial sequence
  Synthesized sequence
tttgcccagccgctgca

SEQ ID NO: 3491 - DNA, 17 bp, Artificial sequence
  Synthesized sequence
atggcgtgctggtggcg

SEQ ID NO: 3492 - DNA, 17 bp, Artificial sequence
  Synthesized sequence
gtggcggagcactcgcg

SEQ ID NO: 3493 - DNA, 17 bp, Artificial sequence
  Synthesized sequence
ctggaacggaccctggg

SEQ ID NO: 3494 - DNA, 17 bp, Artificial sequence
  Synthesized sequence
ctggcgcggaccctgtg

SEQ ID NO: 3495 - DNA, 17 bp, Artificial sequence
  Synthesized sequence
atcggacgaccatggct

SEQ ID NO: 3496 - DNA, 17 bp, Artificial sequence
  Synthesized sequence
ctggcgggcctcccgct

SEQ ID NO: 3497 - DNA, 17 bp, Artificial sequence
  Synthesized sequence
gcggcatgggcatcgcc

SEQ ID NO: 3498 - DNA, 17 bp, Artificial sequence
  Synthesized sequence
atggcgtgtgcctcgcg

SEQ ID NO: 3499 - DNA, 17 bp, Artificial sequence
  Synthesized sequence
gcggcccagcagttgaa

SEQ ID NO: 3500 - DNA, 17 bp, Artificial sequence
  Synthesized sequence
ctgggccacggtctgca

SEQ ID NO: 3501 - DNA, 17 bp, Artificial sequence
  Synthesized sequence
ctggcgcatcagcggct

SEQ ID NO: 3502 - DNA, 17 bp, Artificial sequence
  Synthesized sequence
tcggcaccctgttcgcg

SEQ ID NO: 3503 - DNA, 17 bp, Artificial sequence
  Synthesized sequence
tcggcagcattattgat

SEQ ID NO: 3504 - DNA, 17 bp, Artificial sequence
  Synthesized sequence
ctggccgacgagttcct

SEQ ID NO: 3505 - DNA, 17 bp, Artificial sequence
  Synthesized sequence
ctggcctgcctgctgat

SEQ ID NO: 3506 - DNA, 17 bp, Artificial sequence
  Synthesized sequence
ctggcctgcctgctgat

SEQ ID NO: 3507 - DNA, 17 bp, Artificial sequence
  Synthesized sequence
atggggcactggctgca

SEQ ID NO: 3508 - DNA, 17 bp, Artificial sequence
  Synthesized sequence
gtgccccgggtcatgcg

SEQ ID NO: 3509 - DNA, 17 bp, Artificial sequence
  Synthesized sequence
atggctcgtaccatgga

SEQ ID NO: 3510 - DNA, 17 bp, Artificial sequence
  Synthesized sequence
gtggttcggtgactgcc

SEQ ID NO: 3511 - DNA, 17 bp, Artificial sequence
  Synthesized sequence
gtgccctgctgcttgcg

SEQ ID NO: 3512 - DNA, 17 bp, Artificial sequence
  Synthesized sequence
tttgtagggcgtttgcc

SEQ ID NO: 3513 - DNA, 17 bp, Artificial sequence
  Synthesized sequence
ttgacactgtttttggg

SEQ ID NO: 3514 - DNA, 17 bp, Artificial sequence
  Synthesized sequence
ctggctgggcatttccg

SEQ ID NO: 3515 - DNA, 17 bp, Artificial sequence
  Synthesized sequence
ctggctcgcctggagcg

SEQ ID NO: 3516 - DNA, 17 bp, Artificial sequence
  Synthesized sequence
ttgccgcgaccttttct

SEQ ID NO: 3517 - DNA, 17 bp, Artificial sequence
  Synthesized sequence
tcggcagagcaactgcg

SEQ ID NO: 3518 - DNA, 17 bp, Artificial sequence
  Synthesized sequence
cttgcacatccttcgcc

SEQ ID NO: 3519 - DNA, 17 bp, Artificial sequence
  Synthesized sequence
ctggcccggccaaggcg

SEQ ID NO: 3520 - DNA, 17 bp, Artificial sequence
  Synthesized sequence
ctgtcccgggtatttct

SEQ ID NO: 3521 - DNA, 17 bp, Artificial sequence
  Synthesized sequence
ctgtcccgggtatttct

SEQ ID NO: 3522 - DNA, 17 bp, Artificial sequence
  Synthesized sequence
atggcaagatccgtggg

SEQ ID NO: 3523 - DNA, 17 bp, Artificial sequence
  Synthesized sequence
gcggcccacctgtggca

SEQ ID NO: 3524 - DNA, 17 bp, Artificial sequence
  Synthesized sequence
gtggcaactgcgttgac

SEQ ID NO: 3525 - DNA, 17 bp, Artificial sequence
  Synthesized sequence
ctggcacggcaaatcga

SEQ ID NO: 3526 - DNA, 17 bp, Artificial sequence
  Synthesized sequence
ctggcggtggggctgct

SEQ ID NO: 3527 - DNA, 17 bp, Artificial sequence
  Synthesized sequence
ctggcgcggcgtcggcg

SEQ ID NO: 3528 - DNA, 17 bp, Artificial sequence
  Synthesized sequence
cgggcacgccgcatcca

SEQ ID NO: 3529 - DNA, 17 bp, Artificial sequence
  Synthesized sequence
tccgcagggctattgcg

SEQ ID NO: 3530 - DNA, 17 bp, Artificial sequence
  Synthesized sequence
ctggccatccgttcgct

SEQ ID NO: 3531 - DNA, 17 bp, Artificial sequence
  Synthesized sequence
ctgggcctggacctgca

SEQ ID NO: 3532 - DNA, 17 bp, Artificial sequence
  Synthesized sequence
ctggtcggtctgctgct

SEQ ID NO: 3533 - DNA, 17 bp, Artificial sequence
  Synthesized sequence
ctgtcgcagccgctgca

SEQ ID NO: 3534 - DNA, 17 bp, Artificial sequence
  Synthesized sequence
ccggaacagcggttgat

SEQ ID NO: 3535 - DNA, 17 bp, Artificial sequence
  Synthesized sequence
ctggaatgcctgctggt

SEQ ID NO: 3536 - DNA, 17 bp, Artificial sequence
  Synthesized sequence
ctggccggggcgtcgcg

SEQ ID NO: 3537 - DNA, 17 bp, Artificial sequence
  Synthesized sequence
ctggccgagcgctggcg

SEQ ID NO: 3538 - DNA, 17 bp, Artificial sequence
  Synthesized sequence
atggcatgagcctcacg

SEQ ID NO: 3539 - DNA, 17 bp, Artificial sequence
  Synthesized sequence
ccggcaggccgctggcg

SEQ ID NO: 3540 - DNA, 17 bp, Artificial sequence
  Synthesized sequence
atggccgggtgctggcc

SEQ ID NO: 3541 - DNA, 17 bp, Artificial sequence
  Synthesized sequence
ctggaacgcgactgcca

SEQ ID NO: 3542 - DNA, 17 bp, Artificial sequence
  Synthesized sequence
gcggcacgccgctggaa

SEQ ID NO: 3543 - DNA, 17 bp, Artificial sequence
  Synthesized sequence
gcgggcctgctgttgca

SEQ ID NO: 3544 - DNA, 17 bp, Artificial sequence
  Synthesized sequence
ttggctgtccttttgtt

SEQ ID NO: 3545 - DNA, 17 bp, Artificial sequence
  Synthesized sequence
ccggcccggtcgtttca

SEQ ID NO: 3546 - DNA, 17 bp, Artificial sequence
  Synthesized sequence
gtggcgccgcaggcgct

SEQ ID NO: 3547 - DNA, 17 bp, Artificial sequence
  Synthesized sequence
ctggcgttgcgcctgcg

SEQ ID NO: 3548 - DNA, 17 bp, Artificial sequence
  Synthesized sequence
ctggtacgaatcgttcg

SEQ ID NO: 3549 - DNA, 17 bp, Artificial sequence
  Synthesized sequence
acggcaccccggtcgcc

SEQ ID NO: 3550 - DNA, 17 bp, Artificial sequence
  Synthesized sequence
gcggcatgagcatcgcc

SEQ ID NO: 3551 - DNA, 17 bp, Artificial sequence
  Synthesized sequence
gcggcaaggtgctcgcg

SEQ ID NO: 3552 - DNA, 17 bp, Artificial sequence
  Synthesized sequence
ctcgaacgcgcgctgct

SEQ ID NO: 3553 - DNA, 17 bp, Artificial sequence
  Synthesized sequence
ctggctgggcgttcgcc

SEQ ID NO: 3554 - DNA, 17 bp, Artificial sequence
  Synthesized sequence
ctggacaaggccttgcg

SEQ ID NO: 3555 - DNA, 17 bp, Artificial sequence
  Synthesized sequence
aggggagagcgcttgcg

SEQ ID NO: 3556 - DNA, 17 bp, Artificial sequence
  Synthesized sequence
ctggtacgccctcggcg

SEQ ID NO: 3557 - DNA, 17 bp, Artificial sequence
  Synthesized sequence
ctggaacgcgcctacct

SEQ ID NO: 3558 - DNA, 17 bp, Artificial sequence
  Synthesized sequence
atggctcaatccgcgca

SEQ ID NO: 3559 - DNA, 17 bp, Artificial sequence
  Synthesized sequence
ctggcccacgacatcct

SEQ ID NO: 3560 - DNA, 17 bp, Artificial sequence
  Synthesized sequence
ctggctcaaccagcgca

SEQ ID NO: 3561 - DNA, 17 bp, Artificial sequence
  Synthesized sequence
tcggcaccgcggtttcc

SEQ ID NO: 3562 - DNA, 17 bp, Artificial sequence
  Synthesized sequence
cgggtgctgcccttgca

SEQ ID NO: 3563 - DNA, 17 bp, Artificial sequence
  Synthesized sequence
gtggcggcagggctgct

SEQ ID NO: 3564 - DNA, 17 bp, Artificial sequence
  Synthesized sequence
ctggaaagcgcggtgcg

SEQ ID NO: 3565 - DNA, 17 bp, Artificial sequence
  Synthesized sequence
atggccggactcgtgat

SEQ ID NO: 3566 - DNA, 17 bp, Artificial sequence
  Synthesized sequence
atggcgcgggtcatggc

SEQ ID NO: 3567 - DNA, 17 bp, Artificial sequence
  Synthesized sequence
atggaagcctgggtgct

SEQ ID NO: 3568 - DNA, 17 bp, Artificial sequence
  Synthesized sequence
gtggcgcgacccaggcc

SEQ ID NO: 3569 - DNA, 17 bp, Artificial sequence
  Synthesized sequence
ctggcggggctggcgct

SEQ ID NO: 3570 - DNA, 17 bp, Artificial sequence
  Synthesized sequence
atggcccggcaactggc

SEQ ID NO: 3571 - DNA, 17 bp, Artificial sequence
  Synthesized sequence
ctggcgcggcttctacc

SEQ ID NO: 3572 - DNA, 17 bp, Artificial sequence
  Synthesized sequence
ctggcccgaagccggcg

SEQ ID NO: 3573 - DNA, 17 bp, Artificial sequence
  Synthesized sequence
ctggaacactatccgca

SEQ ID NO: 3574 - DNA, 17 bp, Artificial sequence
  Synthesized sequence
atggcattgctcctggc

SEQ ID NO: 3575 - DNA, 17 bp, Artificial sequence
  Synthesized sequence
atggcacccagggagcg

SEQ ID NO: 3576 - DNA, 17 bp, Artificial sequence
  Synthesized sequence
cgggcaaattttttgtt

SEQ ID NO: 3577 - DNA, 17 bp, Artificial sequence
  Synthesized sequence
acgacacgcccttcgct

SEQ ID NO: 3578 - DNA, 17 bp, Artificial sequence
  Synthesized sequence
gtggccagggggtcgcc

SEQ ID NO: 3579 - DNA, 17 bp, Artificial sequence
  Synthesized sequence
caggcacgcaagctgga

SEQ ID NO: 3580 - DNA, 17 bp, Artificial sequence
  Synthesized sequence
atcgccccgctggtgct

SEQ ID NO: 3581 - DNA, 17 bp, Artificial sequence
  Synthesized sequence
ttcgccgggtgcttgcg

SEQ ID NO: 3582 - DNA, 17 bp, Artificial sequence
  Synthesized sequence
caggcacaaagcctgat

SEQ ID NO: 3583 - DNA, 17 bp, Artificial sequence
  Synthesized sequence
gtgccgccgctggtgct

SEQ ID NO: 3584 - DNA, 17 bp, Artificial sequence
  Synthesized sequence
ttggcccggaccgggcc

SEQ ID NO: 3585 - DNA, 17 bp, Artificial sequence
  Synthesized sequence
gcggcgctgaccgtgct

SEQ ID NO: 3586 - DNA, 17 bp, Artificial sequence
  Synthesized sequence
ctgcctgaatccttgct

SEQ ID NO: 3587 - DNA, 17 bp, Artificial sequence
  Synthesized sequence
atgggtcgccgcctgcc

SEQ ID NO: 3588 - DNA, 17 bp, Artificial sequence
  Synthesized sequence
caggcgcgatacctgcg

SEQ ID NO: 3589 - DNA, 17 bp, Artificial sequence
  Synthesized sequence
atggccggggcatcgcg

SEQ ID NO: 3590 - DNA, 17 bp, Artificial sequence
  Synthesized sequence
caggccctggacgtgct

SEQ ID NO: 3591 - DNA, 17 bp, Artificial sequence
  Synthesized sequence
ttgacctcaagtttgct

SEQ ID NO: 3592 - DNA, 17 bp, Artificial sequence
  Synthesized sequence
ctggctggcgggttcca

SEQ ID NO: 3593 - DNA, 17 bp, Artificial sequence
  Synthesized sequence
gcggcgctgtgcctgct

SEQ ID NO: 3594 - DNA, 17 bp, Artificial sequence
  Synthesized sequence
ccggaaggggctttgcc

SEQ ID NO: 3595 - DNA, 17 bp, Artificial sequence
  Synthesized sequence
gtggtcggcatgctgct

SEQ ID NO: 3596 - DNA, 17 bp, Artificial sequence
  Synthesized sequence
caggcccggcggctgcg

SEQ ID NO: 3597 - DNA, 17 bp, Artificial sequence
  Synthesized sequence
tgggcaacgccatcgct

SEQ ID NO: 3598 - DNA, 17 bp, Artificial sequence
  Synthesized sequence
ctggcaccagctctccg

SEQ ID NO: 3599 - DNA, 17 bp, Artificial sequence
  Synthesized sequence
caggcactaaggtagcg

SEQ ID NO: 3600 - DNA, 17 bp, Artificial sequence
  Synthesized sequence
atcgcgcgagcctggct

SEQ ID NO: 3601 - DNA, 17 bp, Artificial sequence
  Synthesized sequence
ctgacgctggacttgcc

SEQ ID NO: 3602 - DNA, 17 bp, Artificial sequence
  Synthesized sequence
gtggaatgcctggcgca

SEQ ID NO: 3603 - DNA, 17 bp, Artificial sequence
  Synthesized sequence
ctggcgcaatgcgcgca

SEQ ID NO: 3604 - DNA, 17 bp, Artificial sequence
  Synthesized sequence
ctggcgatcttctggca

SEQ ID NO: 3605 - DNA, 17 bp, Artificial sequence
  Synthesized sequence
gcggcacgcgcctcgat

SEQ ID NO: 3606 - DNA, 17 bp, Artificial sequence
  Synthesized sequence
ctgggagggctggcgct

SEQ ID NO: 3607 - DNA, 17 bp, Artificial sequence
  Synthesized sequence
tcggcgcgggcattcca

SEQ ID NO: 3608 - DNA, 17 bp, Artificial sequence
  Synthesized sequence
tcggccacggcgttgct

SEQ ID NO: 3609 - DNA, 17 bp, Artificial sequence
  Synthesized sequence
ctggccagtccctcgcc

SEQ ID NO: 3610 - DNA, 17 bp, Artificial sequence
  Synthesized sequence
gcggcgcgtgcctggct

SEQ ID NO: 3611 - DNA, 17 bp, Artificial sequence
  Synthesized sequence
gtggaacggcatgtggg

SEQ ID NO: 3612 - DNA, 17 bp, Artificial sequence
  Synthesized sequence
gaggtcctgcaattgca

SEQ ID NO: 3613 - DNA, 17 bp, Artificial sequence
  Synthesized sequence
agggcatgagcttcgcc

SEQ ID NO: 3614 - DNA, 17 bp, Artificial sequence
  Synthesized sequence
gaggtcctgcaattgca

SEQ ID NO: 3615 - DNA, 17 bp, Artificial sequence
  Synthesized sequence
gcggcgcggccctggcg

SEQ ID NO: 3616 - DNA, 17 bp, Artificial sequence
  Synthesized sequence
ctggtaccgccgccgca

SEQ ID NO: 3617 - DNA, 17 bp, Artificial sequence
  Synthesized sequence
gtggtactcctcgtgga

SEQ ID NO: 3618 - DNA, 17 bp, Artificial sequence
  Synthesized sequence
ctggcctggctgatcct

SEQ ID NO: 3619 - DNA, 17 bp, Artificial sequence
  Synthesized sequence
tttgaatgagaattgcc

SEQ ID NO: 3620 - DNA, 17 bp, Artificial sequence
  Synthesized sequence
atggcacagcctccgga

SEQ ID NO: 3621 - DNA, 17 bp, Artificial sequence
  Synthesized sequence
ctgcccgccctgttgct

SEQ ID NO: 3622 - DNA, 17 bp, Artificial sequence
  Synthesized sequence
ctggccctgcccgcgca

SEQ ID NO: 3623 - DNA, 17 bp, Artificial sequence
  Synthesized sequence
cgggcagggcagttggg

SEQ ID NO: 3624 - DNA, 17 bp, Artificial sequence
  Synthesized sequence
ctggtgctggaactgct

SEQ ID NO: 3625 - DNA, 17 bp, Artificial sequence
  Synthesized sequence
gtggccaggctggcgct

SEQ ID NO: 3626 - DNA, 17 bp, Artificial sequence
  Synthesized sequence
gtgccgctgaggttgcc

SEQ ID NO: 3627 - DNA, 17 bp, Artificial sequence
  Synthesized sequence
ctgggccagctggtgcc

SEQ ID NO: 3628 - DNA, 17 bp, Artificial sequence
  Synthesized sequence
ctggtgcgtgtcctgcc

SEQ ID NO: 3629 - DNA, 17 bp, Artificial sequence
  Synthesized sequence
gagggacaatgggtgct

SEQ ID NO: 3630 - DNA, 17 bp, Artificial sequence
  Synthesized sequence
ctgggacaggcccggca

SEQ ID NO: 3631 - DNA, 17 bp, Artificial sequence
  Synthesized sequence
atcgccgaggcattgct

SEQ ID NO: 3632 - DNA, 17 bp, Artificial sequence
  Synthesized sequence
tcggcaccctcctggcc

SEQ ID NO: 3633 - DNA, 17 bp, Artificial sequence
  Synthesized sequence
ccggctcagcggtggct

SEQ ID NO: 3634 - DNA, 17 bp, Artificial sequence
  Synthesized sequence
gtggtgctggaactgca

SEQ ID NO: 3635 - DNA, 17 bp, Artificial sequence
  Synthesized sequence
ctgaccctgctggtgct

SEQ ID NO: 3636 - DNA, 17 bp, Artificial sequence
  Synthesized sequence
ctggcgcaagggccgct

SEQ ID NO: 3637 - DNA, 17 bp, Artificial sequence
  Synthesized sequence
ctggccgagcgctggcg

SEQ ID NO: 3638 - DNA, 17 bp, Artificial sequence
  Synthesized sequence
gacgtacagcgtttgct

SEQ ID NO: 3639 - DNA, 17 bp, Artificial sequence
  Synthesized sequence
ctggcgcagctcttcga

SEQ ID NO: 3640 - DNA, 17 bp, Artificial sequence
  Synthesized sequence
ctcggactatgcttgcc

SEQ ID NO: 3641 - DNA, 17 bp, Artificial sequence
  Synthesized sequence
tttgcgcagcccatgca

SEQ ID NO: 3642 - DNA, 17 bp, Artificial sequence
  Synthesized sequence
aaggcacgggcctgggt

SEQ ID NO: 3643 - DNA, 17 bp, Artificial sequence
  Synthesized sequence
gtggccgaggggttgga

SEQ ID NO: 3644 - DNA, 17 bp, Artificial sequence
  Synthesized sequence
gcagcacgccacttggt

SEQ ID NO: 3645 - DNA, 17 bp, Artificial sequence
  Synthesized sequence
cgggaagtgccattgca

SEQ ID NO: 3646 - DNA, 17 bp, Artificial sequence
  Synthesized sequence
ctggccaagtgcctgcg

SEQ ID NO: 3647 - DNA, 17 bp, Artificial sequence
  Synthesized sequence
ctggtccgcgacctgcc

SEQ ID NO: 3648 - DNA, 17 bp, Artificial sequence
  Synthesized sequence
ctggtacgtgctcggca

SEQ ID NO: 3649 - DNA, 17 bp, Artificial sequence
  Synthesized sequence
atggctcggcccacgcc

SEQ ID NO: 3650 - DNA, 17 bp, Artificial sequence
  Synthesized sequence
tgggcaccggcctggcc

SEQ ID NO: 3651 - DNA, 17 bp, Artificial sequence
  Synthesized sequence
gtggaactgctggtggt

SEQ ID NO: 3652 - DNA, 17 bp, Artificial sequence
  Synthesized sequence
ctggcgcgcctggcgcg

SEQ ID NO: 3653 - DNA, 17 bp, Artificial sequence
  Synthesized sequence
atggcgcccccattccg

SEQ ID NO: 3654 - DNA, 17 bp, Artificial sequence
  Synthesized sequence
atagccaccctgttgct

SEQ ID NO: 3655 - DNA, 17 bp, Artificial sequence
  Synthesized sequence
gtggcaccgggactggc

SEQ ID NO: 3656 - DNA, 17 bp, Artificial sequence
  Synthesized sequence
ggggaatggttgatgca

SEQ ID NO: 3657 - DNA, 17 bp, Artificial sequence
  Synthesized sequence
gtggaacccttcctggt

SEQ ID NO: 3658 - DNA, 17 bp, Artificial sequence
  Synthesized sequence
gtggcataggcgacgcg

SEQ ID NO: 3659 - DNA, 17 bp, Artificial sequence
  Synthesized sequence
ctggcccaggccatgga

SEQ ID NO: 3660 - DNA, 17 bp, Artificial sequence
  Synthesized sequence
gtggcttccgcctggca

SEQ ID NO: 3661 - DNA, 17 bp, Artificial sequence
  Synthesized sequence
ctggccggcgcctcgcc

SEQ ID NO: 3662 - DNA, 17 bp, Artificial sequence
  Synthesized sequence
ccggcaagggcctggcg

SEQ ID NO: 3663 - DNA, 17 bp, Artificial sequence
  Synthesized sequence
ccggcgccgccggtgct

SEQ ID NO: 3664 - DNA, 17 bp, Artificial sequence
  Synthesized sequence
gtcgcagccatgctgct

SEQ ID NO: 3665 - DNA, 17 bp, Artificial sequence
  Synthesized sequence
atggcgctgcgcctgat

SEQ ID NO: 3666 - DNA, 17 bp, Artificial sequence
  Synthesized sequence
ttggaactggtcaagct

SEQ ID NO: 3667 - DNA, 17 bp, Artificial sequence
  Synthesized sequence
aaggcacaattgctggt

SEQ ID NO: 3668 - DNA, 17 bp, Artificial sequence
  Synthesized sequence
ctggcacggcactatga

SEQ ID NO: 3669 - DNA, 17 bp, Artificial sequence
  Synthesized sequence
ctggcacggcactatga

SEQ ID NO: 3670 - DNA, 17 bp, Artificial sequence
  Synthesized sequence
gcggcacgacggcttca

SEQ ID NO: 3671 - DNA, 17 bp, Artificial sequence
  Synthesized sequence
atggctcaccaggagct

SEQ ID NO: 3672 - DNA, 17 bp, Artificial sequence
  Synthesized sequence
atggctcaccaggagct

SEQ ID NO: 3673 - DNA, 17 bp, Artificial sequence
  Synthesized sequence
ttggcctggccggcgct

SEQ ID NO: 3674 - DNA, 17 bp, Artificial sequence
  Synthesized sequence
tcggcacgcacacagca

SEQ ID NO: 3675 - DNA, 17 bp, Artificial sequence
  Synthesized sequence
ctggcccaggacatgga

SEQ ID NO: 3676 - DNA, 17 bp, Artificial sequence
  Synthesized sequence
ctggcgctgatcgtcct

SEQ ID NO: 3677 - DNA, 17 bp, Artificial sequence
  Synthesized sequence
ctggcgaagccctggcg

SEQ ID NO: 3678 - DNA, 17 bp, Artificial sequence
  Synthesized sequence
gtcgagcaggacttgca

SEQ ID NO: 3679 - DNA, 17 bp, Artificial sequence
  Synthesized sequence
atgtcgcggcaattact

SEQ ID NO: 3680 - DNA, 17 bp, Artificial sequence
  Synthesized sequence
ctggcgagcgcctcgcc

SEQ ID NO: 3681 - DNA, 17 bp, Artificial sequence
  Synthesized sequence
acgggacgggagttgta

SEQ ID NO: 3682 - DNA, 17 bp, Artificial sequence
  Synthesized sequence
acgggacgggagttgta

SEQ ID NO: 3683 - DNA, 17 bp, Artificial sequence
  Synthesized sequence
agggcattcgcctcgct

SEQ ID NO: 3684 - DNA, 17 bp, Artificial sequence
  Synthesized sequence
ctgccccggcacatgcg

SEQ ID NO: 3685 - DNA, 17 bp, Artificial sequence
  Synthesized sequence
atggctaggcattttcc

SEQ ID NO: 3686 - DNA, 17 bp, Artificial sequence
  Synthesized sequence
ctggcgatcgccgtgca

SEQ ID NO: 3687 - DNA, 17 bp, Artificial sequence
  Synthesized sequence
ctggcagatcctgcgca

SEQ ID NO: 3688 - DNA, 17 bp, Artificial sequence
  Synthesized sequence
gttgcgttccagttgct

SEQ ID NO: 3689 - DNA, 17 bp, Artificial sequence
  Synthesized sequence
gtgccgcagcaggtgca

SEQ ID NO: 3690 - DNA, 17 bp, Artificial sequence
  Synthesized sequence
ctggaaagccaatagcc

SEQ ID NO: 3691 - DNA, 17 bp, Artificial sequence
  Synthesized sequence
ctggcggaaaacctgcg

SEQ ID NO: 3692 - DNA, 17 bp, Artificial sequence
  Synthesized sequence
gttgccagcatgttgcc

SEQ ID NO: 3693 - DNA, 17 bp, Artificial sequence
  Synthesized sequence
atggcatccatccggcg

SEQ ID NO: 3694 - DNA, 17 bp, Artificial sequence
  Synthesized sequence
atggcatccatccggcg

SEQ ID NO: 3695 - DNA, 17 bp, Artificial sequence
  Synthesized sequence
ctggtgccgtttttcct

SEQ ID NO: 3696 - DNA, 17 bp, Artificial sequence
  Synthesized sequence
ctggcgcggatagtggc

SEQ ID NO: 3697 - DNA, 17 bp, Artificial sequence
  Synthesized sequence
gcgccccgcaagttgct

SEQ ID NO: 3698 - DNA, 17 bp, Artificial sequence
  Synthesized sequence
ctcgcccgtcgcgtgca

SEQ ID NO: 3699 - DNA, 17 bp, Artificial sequence
  Synthesized sequence
ctggcaatggcgcggct

SEQ ID NO: 3700 - DNA, 17 bp, Artificial sequence
  Synthesized sequence
ctcgcgctgttcctgct

SEQ ID NO: 3701 - DNA, 17 bp, Artificial sequence
  Synthesized sequence
cgggcaatggcctcgct

SEQ ID NO: 3702 - DNA, 17 bp, Artificial sequence
  Synthesized sequence
caggctcagcgctttct

SEQ ID NO: 3703 - DNA, 17 bp, Artificial sequence
  Synthesized sequence
agggcaaggccttcgcc

SEQ ID NO: 3704 - DNA, 17 bp, Artificial sequence
  Synthesized sequence
ctggcgcgcctggagcg

SEQ ID NO: 3705 - DNA, 17 bp, Artificial sequence
  Synthesized sequence
atggaacacccgctgaa

SEQ ID NO: 3706 - DNA, 17 bp, Artificial sequence
  Synthesized sequence
ctggcgcgcctggcgcc

SEQ ID NO: 3707 - DNA, 17 bp, Artificial sequence
  Synthesized sequence
ctggcctggagcctgtt

SEQ ID NO: 3708 - DNA, 17 bp, Artificial sequence
  Synthesized sequence
ccgccacggcggtcgct

SEQ ID NO: 3709 - DNA, 17 bp, Artificial sequence
  Synthesized sequence
gtggccgcaggcgtgca

SEQ ID NO: 3710 - DNA, 17 bp, Artificial sequence
  Synthesized sequence
gttgcacaaccccggct

SEQ ID NO: 3711 - DNA, 17 bp, Artificial sequence
  Synthesized sequence
ctggcgcactacgcgca

SEQ ID NO: 3712 - DNA, 17 bp, Artificial sequence
  Synthesized sequence
ctggcaccagcgctgtc

SEQ ID NO: 3713 - DNA, 17 bp, Artificial sequence
  Synthesized sequence
gtgggcctggccctgct

SEQ ID NO: 3714 - DNA, 17 bp, Artificial sequence
  Synthesized sequence
ctggccctgctggtgtt

SEQ ID NO: 3715 - DNA, 17 bp, Artificial sequence
  Synthesized sequence
gaggcgcggatcttgtg

SEQ ID NO: 3716 - DNA, 17 bp, Artificial sequence
  Synthesized sequence
ctgacccgtaaactgca

SEQ ID NO: 3717 - DNA, 17 bp, Artificial sequence
  Synthesized sequence
acggcaccctcgtggcg

SEQ ID NO: 3718 - DNA, 17 bp, Artificial sequence
  Synthesized sequence
ttgccgaggatgttgcc

SEQ ID NO: 3719 - DNA, 17 bp, Artificial sequence
  Synthesized sequence
ctggcgcaggaagcgca

SEQ ID NO: 3720 - DNA, 17 bp, Artificial sequence
  Synthesized sequence
ctggcacggggtgcgaa

SEQ ID NO: 3721 - DNA, 17 bp, Artificial sequence
  Synthesized sequence
gtggcgtgccctccgct

SEQ ID NO: 3722 - DNA, 17 bp, Artificial sequence
  Synthesized sequence
ctgggccaccagttcct

SEQ ID NO: 3723 - DNA, 17 bp, Artificial sequence
  Synthesized sequence
cgggtacgcatttcgcg

SEQ ID NO: 3724 - DNA, 17 bp, Artificial sequence
  Synthesized sequence
ctggcacgggccggaca

SEQ ID NO: 3725 - DNA, 17 bp, Artificial sequence
  Synthesized sequence
aaggccctgccggtgct

SEQ ID NO: 3726 - DNA, 17 bp, Artificial sequence
  Synthesized sequence
gtggcaagggctacgcg

SEQ ID NO: 3727 - DNA, 17 bp, Artificial sequence
  Synthesized sequence
ctggtgcgtcatctgcc

SEQ ID NO: 3728 - DNA, 17 bp, Artificial sequence
  Synthesized sequence
ctggcgcgccttctacg

SEQ ID NO: 3729 - DNA, 17 bp, Artificial sequence
  Synthesized sequence
gtgccgcgctagtcgct

SEQ ID NO: 3730 - DNA, 17 bp, Artificial sequence
  Synthesized sequence
caggccctgcctgtgct

SEQ ID NO: 3731 - DNA, 17 bp, Artificial sequence
  Synthesized sequence
gtcgaactgctgctgct

SEQ ID NO: 3732 - DNA, 17 bp, Artificial sequence
  Synthesized sequence
ctggcctatgccctgcg

SEQ ID NO: 3733 - DNA, 17 bp, Artificial sequence
  Synthesized sequence
tggggttggcccttgct

SEQ ID NO: 3734 - DNA, 17 bp, Artificial sequence
  Synthesized sequence
gttgcaggtcgctggca

SEQ ID NO: 3735 - DNA, 17 bp, Artificial sequence
  Synthesized sequence
ctggtcggcctgtcgct

SEQ ID NO: 3736 - DNA, 17 bp, Artificial sequence
  Synthesized sequence
ccggcgcccgtcgtgct

SEQ ID NO: 3737 - DNA, 17 bp, Artificial sequence
  Synthesized sequence
tagggccatatgttgca

SEQ ID NO: 3738 - DNA, 17 bp, Artificial sequence
  Synthesized sequence
ctggccgcgctgctgcg

SEQ ID NO: 3739 - DNA, 17 bp, Artificial sequence
  Synthesized sequence
ccagcacggtgtctgca

SEQ ID NO: 3740 - DNA, 17 bp, Artificial sequence
  Synthesized sequence
acggtaagtgttttgcc

SEQ ID NO: 3741 - DNA, 17 bp, Artificial sequence
  Synthesized sequence
ctggctaccgccgtgct

SEQ ID NO: 3742 - DNA, 17 bp, Artificial sequence
  Synthesized sequence
ctggtgcgcgtctggcg

SEQ ID NO: 3743 - DNA, 17 bp, Artificial sequence
  Synthesized sequence
ctggcagggccactggc

SEQ ID NO: 3744 - DNA, 17 bp, Artificial sequence
  Synthesized sequence
ctggaacaaggacggct

SEQ ID NO: 3745 - DNA, 17 bp, Artificial sequence
  Synthesized sequence
ttcgaaccgttcatgct

SEQ ID NO: 3746 - DNA, 17 bp, Artificial sequence
  Synthesized sequence
caggcgaggctgatgct

SEQ ID NO: 3747 - DNA, 17 bp, Artificial sequence
  Synthesized sequence
gaagcccgcgagttgct

SEQ ID NO: 3748 - DNA, 17 bp, Artificial sequence
  Synthesized sequence
gttgaacgttacctgca

SEQ ID NO: 3749 - DNA, 17 bp, Artificial sequence
  Synthesized sequence
gcggcgcctcgattgcc

SEQ ID NO: 3750 - DNA, 17 bp, Artificial sequence
  Synthesized sequence
ctggtccgaaggctgcc

SEQ ID NO: 3751 - DNA, 17 bp, Artificial sequence
  Synthesized sequence
ctgccgccgaagttgcc

SEQ ID NO: 3752 - DNA, 17 bp, Artificial sequence
  Synthesized sequence
ctggcgcacgtcgttca

SEQ ID NO: 3753 - DNA, 17 bp, Artificial sequence
  Synthesized sequence
ttggctggagcgctgcg

SEQ ID NO: 3754 - DNA, 17 bp, Artificial sequence
  Synthesized sequence
ctgtcacgcaccctgat

SEQ ID NO: 3755 - DNA, 17 bp, Artificial sequence
  Synthesized sequence
cttgtaatgtgcttgct

SEQ ID NO: 3756 - DNA, 17 bp, Artificial sequence
  Synthesized sequence
atgatctggctgttgca

SEQ ID NO: 3757 - DNA, 17 bp, Artificial sequence
  Synthesized sequence
gtgggaaagtggtttca

SEQ ID NO: 3758 - DNA, 17 bp, Artificial sequence
  Synthesized sequence
gtcgcgcagcgaatgct

SEQ ID NO: 3759 - DNA, 17 bp, Artificial sequence
  Synthesized sequence
atggcctcgaactcgcg

SEQ ID NO: 3760 - DNA, 17 bp, Artificial sequence
  Synthesized sequence
gtggcggagctgtagcc

SEQ ID NO: 3761 - DNA, 17 bp, Artificial sequence
  Synthesized sequence
gaggcaagcgccatgcg

SEQ ID NO: 3762 - DNA, 17 bp, Artificial sequence
  Synthesized sequence
gcggcgcggatttcgcc

SEQ ID NO: 3763 - DNA, 17 bp, Artificial sequence
  Synthesized sequence
ctggcgctgattctgat

SEQ ID NO: 3764 - DNA, 17 bp, Artificial sequence
  Synthesized sequence
ctcgaacggctggtgcg

SEQ ID NO: 3765 - DNA, 17 bp, Artificial sequence
  Synthesized sequence
ctggcggaggccatgcg

SEQ ID NO: 3766 - DNA, 17 bp, Artificial sequence
  Synthesized sequence
gcggaacggcactcgcc

SEQ ID NO: 3767 - DNA, 17 bp, Artificial sequence
  Synthesized sequence
ctggccgccggcatgct

SEQ ID NO: 3768 - DNA, 17 bp, Artificial sequence
  Synthesized sequence
ctggtgctggcggtgct

SEQ ID NO: 3769 - DNA, 17 bp, Artificial sequence
  Synthesized sequence
ttgtcaaaggctctgca

SEQ ID NO: 3770 - DNA, 17 bp, Artificial sequence
  Synthesized sequence
gtggcccactaagcgct

SEQ ID NO: 3771 - DNA, 17 bp, Artificial sequence
  Synthesized sequence
ggggtacgtctgatgcg

SEQ ID NO: 3772 - DNA, 17 bp, Artificial sequence
  Synthesized sequence
tcggcccggcagatgcc

SEQ ID NO: 3773 - DNA, 17 bp, Artificial sequence
  Synthesized sequence
tcggccggcagcttgcc

SEQ ID NO: 3774 - DNA, 17 bp, Artificial sequence
  Synthesized sequence
ctgggagagcatctgcc

SEQ ID NO: 3775 - DNA, 17 bp, Artificial sequence
  Synthesized sequence
gtggcggaggtgctgcc

SEQ ID NO: 3776 - DNA, 17 bp, Artificial sequence
  Synthesized sequence
ttcgcccagtccatgca

SEQ ID NO: 3777 - DNA, 17 bp, Artificial sequence
  Synthesized sequence
ccggcaagtggctttct

SEQ ID NO: 3778 - DNA, 17 bp, Artificial sequence
  Synthesized sequence
ctggcgagaagctggcg

SEQ ID NO: 3779 - DNA, 17 bp, Artificial sequence
  Synthesized sequence
ctggcacgcccagggta

SEQ ID NO: 3780 - DNA, 17 bp, Artificial sequence
  Synthesized sequence
gcggcacgctcacagca

SEQ ID NO: 3781 - DNA, 17 bp, Artificial sequence
  Synthesized sequence
agggcaagaccttcgcc

SEQ ID NO: 3782 - DNA, 17 bp, Artificial sequence
  Synthesized sequence
acggtaccggtggtgct

SEQ ID NO: 3783 - DNA, 17 bp, Artificial sequence
  Synthesized sequence
ctggctttcgattcgct

SEQ ID NO: 3784 - DNA, 17 bp, Artificial sequence
  Synthesized sequence
ctggtacggcgcctggc

SEQ ID NO: 3785 - DNA, 17 bp, Artificial sequence
  Synthesized sequence
tgggcctggctgttgtt

SEQ ID NO: 3786 - DNA, 17 bp, Artificial sequence
  Synthesized sequence
gtggtactttcctagcc

SEQ ID NO: 3787 - DNA, 17 bp, Artificial sequence
  Synthesized sequence
ttggtatcgcggatgcc

SEQ ID NO: 3788 - DNA, 17 bp, Artificial sequence
  Synthesized sequence
ctgccctggcgcctgct

SEQ ID NO: 3789 - DNA, 17 bp, Artificial sequence
  Synthesized sequence
tgggcgcggccctggcg

SEQ ID NO: 3790 - DNA, 17 bp, Artificial sequence
  Synthesized sequence
ctggcccacggcctgtt

SEQ ID NO: 3791 - DNA, 17 bp, Artificial sequence
  Synthesized sequence
ctggcgctgtacccgct

SEQ ID NO: 3792 - DNA, 17 bp, Artificial sequence
  Synthesized sequence
ttgggtcatcgcctgca

SEQ ID NO: 3793 - DNA, 17 bp, Artificial sequence
  Synthesized sequence
atgccaccccggctgcg

SEQ ID NO: 3794 - DNA, 17 bp, Artificial sequence
  Synthesized sequence
ctgacccccgttttgcc

SEQ ID NO: 3795 - DNA, 17 bp, Artificial sequence
  Synthesized sequence
ctggcccaggcgcagca

SEQ ID NO: 3796 - DNA, 17 bp, Artificial sequence
  Synthesized sequence
tgggcgacctgcttgct

SEQ ID NO: 3797 - DNA, 17 bp, Artificial sequence
  Synthesized sequence
cgcgcacaagcgttgcc

SEQ ID NO: 3798 - DNA, 17 bp, Artificial sequence
  Synthesized sequence
ctggaagccgaagtgct

SEQ ID NO: 3799 - DNA, 17 bp, Artificial sequence
  Synthesized sequence
ctggcacccggcctacc

SEQ ID NO: 3800 - DNA, 17 bp, Artificial sequence
  Synthesized sequence
gtgcccctgctgctgct

SEQ ID NO: 3801 - DNA, 17 bp, Artificial sequence
  Synthesized sequence
ttggccggaagcttccg

SEQ ID NO: 3802 - DNA, 17 bp, Artificial sequence
  Synthesized sequence
ctggcggccgggctgct

SEQ ID NO: 3803 - DNA, 17 bp, Artificial sequence
  Synthesized sequence
ctggagcatccgatgct

SEQ ID NO: 3804 - DNA, 17 bp, Artificial sequence
  Synthesized sequence
ttgggacgccacgcgcc

SEQ ID NO: 3805 - DNA, 17 bp, Artificial sequence
  Synthesized sequence
ctggtactggtgctgtt

SEQ ID NO: 3806 - DNA, 17 bp, Artificial sequence
  Synthesized sequence
ttcgccctggtcctgct

SEQ ID NO: 3807 - DNA, 17 bp, Artificial sequence
  Synthesized sequence
caggccctggtggtgct

SEQ ID NO: 3808 - DNA, 17 bp, Artificial sequence
  Synthesized sequence
gcggcatgcacatcgcc

SEQ ID NO: 3809 - DNA, 17 bp, Artificial sequence
  Synthesized sequence
ctggccaccgccgtgca

SEQ ID NO: 3810 - DNA, 17 bp, Artificial sequence
  Synthesized sequence
ccggtacgcgctttcct

SEQ ID NO: 3811 - DNA, 17 bp, Artificial sequence
  Synthesized sequence
ctggcgcgccacttcga

SEQ ID NO: 3812 - DNA, 17 bp, Artificial sequence
  Synthesized sequence
gtggcgagaagttcgcc

SEQ ID NO: 3813 - DNA, 17 bp, Artificial sequence
  Synthesized sequence
acggcccggccagtgcc

SEQ ID NO: 3814 - DNA, 17 bp, Artificial sequence
  Synthesized sequence
ctgctgcggcgcttgcg

SEQ ID NO: 3815 - DNA, 17 bp, Artificial sequence
  Synthesized sequence
gtggaagcggaggtgca

SEQ ID NO: 3816 - DNA, 17 bp, Artificial sequence
  Synthesized sequence
atggcaggtcaatgaca

SEQ ID NO: 3817 - DNA, 17 bp, Artificial sequence
  Synthesized sequence
gtggcggcgctgatgcg

SEQ ID NO: 3818 - DNA, 17 bp, Artificial sequence
  Synthesized sequence
aaggctcactcactgct

SEQ ID NO: 3819 - DNA, 17 bp, Artificial sequence
  Synthesized sequence
ttggaagggctcgttct

SEQ ID NO: 3820 - DNA, 17 bp, Artificial sequence
  Synthesized sequence
ctggcgaaggtttcgcg

SEQ ID NO: 3821 - DNA, 17 bp, Artificial sequence
  Synthesized sequence
ccggcctggccggtgca

SEQ ID NO: 3822 - DNA, 17 bp, Artificial sequence
  Synthesized sequence
caggcaaggcacttccc

SEQ ID NO: 3823 - DNA, 17 bp, Artificial sequence
  Synthesized sequence
tcggcattcgtcttact

SEQ ID NO: 3824 - DNA, 17 bp, Artificial sequence
  Synthesized sequence
ctggcggccgaggtgct

SEQ ID NO: 3825 - DNA, 17 bp, Artificial sequence
  Synthesized sequence
ccggcgccgctctggca

SEQ ID NO: 3826 - DNA, 17 bp, Artificial sequence
  Synthesized sequence
gtcgctccacgattgcg

SEQ ID NO: 3827 - DNA, 17 bp, Artificial sequence
  Synthesized sequence
ttcgcgcagcgcgtgca

SEQ ID NO: 3828 - DNA, 17 bp, Artificial sequence
  Synthesized sequence
caggcgctgcgcatgct

SEQ ID NO: 3829 - DNA, 17 bp, Artificial sequence
  Synthesized sequence
gtggcgtagcggtcgcc

SEQ ID NO: 3830 - DNA, 17 bp, Artificial sequence
  Synthesized sequence
tcggcacgcgcgctgtt

SEQ ID NO: 3831 - DNA, 17 bp, Artificial sequence
  Synthesized sequence
ctggcgcccggaatgcc

SEQ ID NO: 3832 - DNA, 17 bp, Artificial sequence
  Synthesized sequence
taggcgagcgacttgcc

SEQ ID NO: 3833 - DNA, 17 bp, Artificial sequence
  Synthesized sequence
gcggcgcgggtctggcg

SEQ ID NO: 3834 - DNA, 17 bp, Artificial sequence
  Synthesized sequence
gcggcacgctgaaagca

SEQ ID NO: 3835 - DNA, 17 bp, Artificial sequence
  Synthesized sequence
ctggaattcgtcctgcc

SEQ ID NO: 3836 - DNA, 17 bp, Artificial sequence
  Synthesized sequence
ctggagctgcgtctgca

SEQ ID NO: 3837 - DNA, 17 bp, Artificial sequence
  Synthesized sequence
tgggcacccgcctcgcc

SEQ ID NO: 3838 - DNA, 17 bp, Artificial sequence
  Synthesized sequence
tgggcatgcaggtcgcg

SEQ ID NO: 3839 - DNA, 17 bp, Artificial sequence
  Synthesized sequence
ctggcggagagcctgcg

SEQ ID NO: 3840 - DNA, 17 bp, Artificial sequence
  Synthesized sequence
ctgggacgaccgccgcg

SEQ ID NO: 3841 - DNA, 17 bp, Artificial sequence
  Synthesized sequence
atggcgcgtcgacttca

SEQ ID NO: 3842 - DNA, 17 bp, Artificial sequence
  Synthesized sequence
ctgggaaggcgtttacg

SEQ ID NO: 3843 - DNA, 17 bp, Artificial sequence
  Synthesized sequence
ctggcgcgcgaggtcca

SEQ ID NO: 3844 - DNA, 17 bp, Artificial sequence
  Synthesized sequence
ctggcccagccgtcgat

SEQ ID NO: 3845 - DNA, 17 bp, Artificial sequence
  Synthesized sequence
tcggcctggctgttcct

SEQ ID NO: 3846 - DNA, 17 bp, Artificial sequence
  Synthesized sequence
ccggcaccaaggtcgcc

SEQ ID NO: 3847 - DNA, 17 bp, Artificial sequence
  Synthesized sequence
cgggcgcggatctcgcc

SEQ ID NO: 3848 - DNA, 17 bp, Artificial sequence
  Synthesized sequence
gtggcgcgccttcggcc

SEQ ID NO: 3849 - DNA, 17 bp, Artificial sequence
  Synthesized sequence
gcggcccggaatatgcc

SEQ ID NO: 3850 - DNA, 17 bp, Artificial sequence
  Synthesized sequence
ctggaatacggcatgcc

SEQ ID NO: 3851 - DNA, 17 bp, Artificial sequence
  Synthesized sequence
cttgcccgtgaactgct

SEQ ID NO: 3852 - DNA, 17 bp, Artificial sequence
  Synthesized sequence
gtggcccgtacagtggt

SEQ ID NO: 3853 - DNA, 17 bp, Artificial sequence
  Synthesized sequence
ctgggacgcggacttct

SEQ ID NO: 3854 - DNA, 17 bp, Artificial sequence
  Synthesized sequence
atggcgaagcgtctgcg

SEQ ID NO: 3855 - DNA, 17 bp, Artificial sequence
  Synthesized sequence
ttggcggaccgcctgcc

SEQ ID NO: 3856 - DNA, 17 bp, Artificial sequence
  Synthesized sequence
atggcatcgaggtcact

SEQ ID NO: 3857 - DNA, 17 bp, Artificial sequence
  Synthesized sequence
ctggcgcaagaccagca

SEQ ID NO: 3858 - DNA, 17 bp, Artificial sequence
  Synthesized sequence
ccggcgcgcctgctgcc

SEQ ID NO: 3859 - DNA, 17 bp, Artificial sequence
  Synthesized sequence
ctggcagatcaacggca

SEQ ID NO: 3860 - DNA, 17 bp, Artificial sequence
  Synthesized sequence
gcgggacgccgattcca

SEQ ID NO: 3861 - DNA, 17 bp, Artificial sequence
  Synthesized sequence
atcgcccacctgctgca

SEQ ID NO: 3862 - DNA, 17 bp, Artificial sequence
  Synthesized sequence
gcggcacggctgaagcc

SEQ ID NO: 3863 - DNA, 17 bp, Artificial sequence
  Synthesized sequence
cggtcacggttttttct

SEQ ID NO: 3864 - DNA, 17 bp, Artificial sequence
  Synthesized sequence
ctggcccgggtcctggc

SEQ ID NO: 3865 - DNA, 17 bp, Artificial sequence
  Synthesized sequence
ctggaacggctgatccg

SEQ ID NO: 3866 - DNA, 17 bp, Artificial sequence
  Synthesized sequence
tgggcatgctcctggcc

SEQ ID NO: 3867 - DNA, 17 bp, Artificial sequence
  Synthesized sequence
gtggggctgggcatgct

SEQ ID NO: 3868 - DNA, 17 bp, Artificial sequence
  Synthesized sequence
gtggccaactggttggt

SEQ ID NO: 3869 - DNA, 17 bp, Artificial sequence
  Synthesized sequence
atggcaccgagctggac

SEQ ID NO: 3870 - DNA, 17 bp, Artificial sequence
  Synthesized sequence
atggaacgacccccgcc

SEQ ID NO: 3871 - DNA, 17 bp, Artificial sequence
  Synthesized sequence
ttggtttggcactttct

SEQ ID NO: 3872 - DNA, 17 bp, Artificial sequence
  Synthesized sequence
ctgggccaactgctgcg

SEQ ID NO: 3873 - DNA, 17 bp, Artificial sequence
  Synthesized sequence
gtggccctgcaactgat

SEQ ID NO: 3874 - DNA, 17 bp, Artificial sequence
  Synthesized sequence
atggcgcgactggagcg

SEQ ID NO: 3875 - DNA, 17 bp, Artificial sequence
  Synthesized sequence
ctggctgaactctcgcc

SEQ ID NO: 3876 - DNA, 17 bp, Artificial sequence
  Synthesized sequence
atggcgagatcttcgcc

SEQ ID NO: 3877 - DNA, 17 bp, Artificial sequence
  Synthesized sequence
gtggtgcagatggtgcg

SEQ ID NO: 3878 - DNA, 17 bp, Artificial sequence
  Synthesized sequence
ctggctcggcgcctggg

SEQ ID NO: 3879 - DNA, 17 bp, Artificial sequence
  Synthesized sequence
gaggcccacgacgtgca

SEQ ID NO: 3880 - DNA, 17 bp, Artificial sequence
  Synthesized sequence
ccggtaccgcagatgca

SEQ ID NO: 3881 - DNA, 17 bp, Artificial sequence
  Synthesized sequence
tgggcccggcgggtgcg

SEQ ID NO: 3882 - DNA, 17 bp, Artificial sequence
  Synthesized sequence
ttcgcatgccgctggcg

SEQ ID NO: 3883 - DNA, 17 bp, Artificial sequence
  Synthesized sequence
gtggtatggtcggcgct

SEQ ID NO: 3884 - DNA, 17 bp, Artificial sequence
  Synthesized sequence
ctggccgcgcacgtgcg

SEQ ID NO: 3885 - DNA, 17 bp, Artificial sequence
  Synthesized sequence
gtgccgcgctcggtgct

SEQ ID NO: 3886 - DNA, 17 bp, Artificial sequence
  Synthesized sequence
gaagcacggcgatggct

SEQ ID NO: 3887 - DNA, 17 bp, Artificial sequence
  Synthesized sequence
ctgccagggcgcatgcc

SEQ ID NO: 3888 - DNA, 17 bp, Artificial sequence
  Synthesized sequence
ctggtgcatgagctgct

SEQ ID NO: 3889 - DNA, 17 bp, Artificial sequence
  Synthesized sequence
ctttctcgactattgct

SEQ ID NO: 3890 - DNA, 17 bp, Artificial sequence
  Synthesized sequence
atggaccgggaactgcc

SEQ ID NO: 3891 - DNA, 17 bp, Artificial sequence
  Synthesized sequence
ctggaaacgagttggct

SEQ ID NO: 3892 - DNA, 17 bp, Artificial sequence
  Synthesized sequence
gtggcgatcgccctgca

SEQ ID NO: 3893 - DNA, 17 bp, Artificial sequence
  Synthesized sequence
ctggccgtggtcctgcg

SEQ ID NO: 3894 - DNA, 17 bp, Artificial sequence
  Synthesized sequence
gcggaactgccggtgct

SEQ ID NO: 3895 - DNA, 17 bp, Artificial sequence
  Synthesized sequence
gtgactcgcggcatgct

SEQ ID NO: 3896 - DNA, 17 bp, Artificial sequence
  Synthesized sequence
atggtccgcccttggcg

SEQ ID NO: 3897 - DNA, 17 bp, Artificial sequence
  Synthesized sequence
gtggcccatgtgcagct

SEQ ID NO: 3898 - DNA, 17 bp, Artificial sequence
  Synthesized sequence
ctggctcgcgaactgga

SEQ ID NO: 3899 - DNA, 17 bp, Artificial sequence
  Synthesized sequence
gtggcagtggccaggct

SEQ ID NO: 3900 - DNA, 17 bp, Artificial sequence
  Synthesized sequence
ctgacctggctggtgct

SEQ ID NO: 3901 - DNA, 17 bp, Artificial sequence
  Synthesized sequence
gaggtgcccatgttgct

SEQ ID NO: 3902 - DNA, 17 bp, Artificial sequence
  Synthesized sequence
atggcataagtcctccg

SEQ ID NO: 3903 - DNA, 17 bp, Artificial sequence
  Synthesized sequence
ctggcctaccgctggcc

SEQ ID NO: 3904 - DNA, 17 bp, Artificial sequence
  Synthesized sequence
acgggccgtctcttgcc

SEQ ID NO: 3905 - DNA, 17 bp, Artificial sequence
  Synthesized sequence
ctcgtagaggcgttgca

SEQ ID NO: 3906 - DNA, 17 bp, Artificial sequence
  Synthesized sequence
gttgcgctgatcctgct

SEQ ID NO: 3907 - DNA, 17 bp, Artificial sequence
  Synthesized sequence
ttggcgctgttgccgct

SEQ ID NO: 3908 - DNA, 17 bp, Artificial sequence
  Synthesized sequence
gtggcggagcgcgtgcc

SEQ ID NO: 3909 - DNA, 17 bp, Artificial sequence
  Synthesized sequence
gaggaacagggaatgct

SEQ ID NO: 3910 - DNA, 17 bp, Artificial sequence
  Synthesized sequence
tcggcgctgccgatgct

SEQ ID NO: 3911 - DNA, 17 bp, Artificial sequence
  Synthesized sequence
ctggcccaggtgtccct

SEQ ID NO: 3912 - DNA, 17 bp, Artificial sequence
  Synthesized sequence
aaggtaccttcattgcc

SEQ ID NO: 3913 - DNA, 17 bp, Artificial sequence
  Synthesized sequence
ctgccctggatgctgct

SEQ ID NO: 3914 - DNA, 17 bp, Artificial sequence
  Synthesized sequence
ctggcgcgcctaccgcc

SEQ ID NO: 3915 - DNA, 17 bp, Artificial sequence
  Synthesized sequence
ctgggacaggtgatcct

SEQ ID NO: 3916 - DNA, 17 bp, Artificial sequence
  Synthesized sequence
ctggatggcgccttgcc

SEQ ID NO: 3917 - DNA, 17 bp, Artificial sequence
  Synthesized sequence
ttggcgtccggcttgaa

SEQ ID NO: 3918 - DNA, 17 bp, Artificial sequence
  Synthesized sequence
ctcggcctgctgttgct

SEQ ID NO: 3919 - DNA, 17 bp, Artificial sequence
  Synthesized sequence
gtggcgagcagggtgcg

SEQ ID NO: 3920 - DNA, 17 bp, Artificial sequence
  Synthesized sequence
ccggcaccgtggtcgcc

SEQ ID NO: 3921 - DNA, 17 bp, Artificial sequence
  Synthesized sequence
gtggcaccggcctcggc

SEQ ID NO: 3922 - DNA, 17 bp, Artificial sequence
  Synthesized sequence
gtggggggaatgctgct

SEQ ID NO: 3923 - DNA, 17 bp, Artificial sequence
  Synthesized sequence
ttggagcagagattggt

SEQ ID NO: 3924 - DNA, 17 bp, Artificial sequence
  Synthesized sequence
ttgggagagggtttcca

SEQ ID NO: 3925 - DNA, 17 bp, Artificial sequence
  Synthesized sequence
atggcccagggcctgaa

SEQ ID NO: 3926 - DNA, 17 bp, Artificial sequence
  Synthesized sequence
atggccagcctccagct

SEQ ID NO: 3927 - DNA, 17 bp, Artificial sequence
  Synthesized sequence
ctggcgctgacccggct

SEQ ID NO: 3928 - DNA, 17 bp, Artificial sequence
  Synthesized sequence
ctgggcattccgttgct

SEQ ID NO: 3929 - DNA, 17 bp, Artificial sequence
  Synthesized sequence
atgccctggctgctgca

SEQ ID NO: 3930 - DNA, 17 bp, Artificial sequence
  Synthesized sequence
ctggcagacctcgcgcc

SEQ ID NO: 3931 - DNA, 17 bp, Artificial sequence
  Synthesized sequence
gcgccatgggccttgcg

SEQ ID NO: 3932 - DNA, 17 bp, Artificial sequence
  Synthesized sequence
ctgcagcacctgttgca

SEQ ID NO: 3933 - DNA, 17 bp, Artificial sequence
  Synthesized sequence
gaggttctgcccttgca

SEQ ID NO: 3934 - DNA, 17 bp, Artificial sequence
  Synthesized sequence
ctgccgcgctcggtgct

SEQ ID NO: 3935 - DNA, 17 bp, Artificial sequence
  Synthesized sequence
tccgcagggctattgcg

SEQ ID NO: 3936 - DNA, 17 bp, Artificial sequence
  Synthesized sequence
ctggccatccgttcgct

SEQ ID NO: 3937 - DNA, 17 bp, Artificial sequence
  Synthesized sequence
ctgggcctggacctgca

SEQ ID NO: 3938 - DNA, 17 bp, Artificial sequence
  Synthesized sequence
cgggcacttcgactgcc

SEQ ID NO: 3939 - DNA, 17 bp, Artificial sequence
  Synthesized sequence
gaggcgcaccggatgct

SEQ ID NO: 3940 - DNA, 17 bp, Artificial sequence
  Synthesized sequence
gtggcaaggtcgctccg

SEQ ID NO: 3941 - DNA, 17 bp, Artificial sequence
  Synthesized sequence
gtggccgtatcttcgct

SEQ ID NO: 3942 - DNA, 17 bp, Artificial sequence
  Synthesized sequence
gcggcaaggtcctggcc

SEQ ID NO: 3943 - DNA, 17 bp, Artificial sequence
  Synthesized sequence
ccggtaccggtctggct

SEQ ID NO: 3944 - DNA, 17 bp, Artificial sequence
  Synthesized sequence
ggggaacgctgatggct

SEQ ID NO: 3945 - DNA, 17 bp, Artificial sequence
  Synthesized sequence
ctgccgctaccgttgcc

SEQ ID NO: 3946 - DNA, 17 bp, Artificial sequence
  Synthesized sequence
ctggccctgcaccggca

SEQ ID NO: 3947 - DNA, 17 bp, Artificial sequence
  Synthesized sequence
tgggccaggatgctgct

SEQ ID NO: 3948 - DNA, 17 bp, Artificial sequence
  Synthesized sequence
gtggcaagctgccggcg

SEQ ID NO: 3949 - DNA, 17 bp, Artificial sequence
  Synthesized sequence
atgggcagacccctgct

SEQ ID NO: 3950 - DNA, 17 bp, Artificial sequence
  Synthesized sequence
aatgcgcgaactttgca

SEQ ID NO: 3951 - DNA, 17 bp, Artificial sequence
  Synthesized sequence
ctggcggcagcgctgct

SEQ ID NO: 3952 - DNA, 17 bp, Artificial sequence
  Synthesized sequence
gtcgcgccttttttgcg

SEQ ID NO: 3953 - DNA, 17 bp, Artificial sequence
  Synthesized sequence
caggtaggcctcatgca

SEQ ID NO: 3954 - DNA, 17 bp, Artificial sequence
  Synthesized sequence
gagggatggagcatgct

SEQ ID NO: 3955 - DNA, 17 bp, Artificial sequence
  Synthesized sequence
ctgccatcgtcgctgct

SEQ ID NO: 3956 - DNA, 17 bp, Artificial sequence
  Synthesized sequence
ttgccggggagcttgcg

SEQ ID NO: 3957 - DNA, 17 bp, Artificial sequence
  Synthesized sequence
ctgtcgccgctggtgct

SEQ ID NO: 3958 - DNA, 17 bp, Artificial sequence
  Synthesized sequence
ctggcgcgcatcgcgcc

SEQ ID NO: 3959 - DNA, 17 bp, Artificial sequence
  Synthesized sequence
ctggcgcgcgactggaa

SEQ ID NO: 3960 - DNA, 17 bp, Artificial sequence
  Synthesized sequence
ttgcgacgatagtcgct

SEQ ID NO: 3961 - DNA, 17 bp, Artificial sequence
  Synthesized sequence
gtggcatggcggtggtc

SEQ ID NO: 3962 - DNA, 17 bp, Artificial sequence
  Synthesized sequence
tgggcaccaccatggcc

SEQ ID NO: 3963 - DNA, 17 bp, Artificial sequence
  Synthesized sequence
gcggcacgtgctcggct

SEQ ID NO: 3964 - DNA, 17 bp, Artificial sequence
  Synthesized sequence
ctggggcgacgactgcc

SEQ ID NO: 3965 - DNA, 17 bp, Artificial sequence
  Synthesized sequence
ttgtcgctgtcgttgcg

SEQ ID NO: 3966 - DNA, 17 bp, Artificial sequence
  Synthesized sequence
ctggccgacagcctgcg

SEQ ID NO: 3967 - DNA, 17 bp, Artificial sequence
  Synthesized sequence
gtggcccactcgccgct

SEQ ID NO: 3968 - DNA, 17 bp, Artificial sequence
  Synthesized sequence
ctggccccgcaactgat

SEQ ID NO: 3969 - DNA, 17 bp, Artificial sequence
  Synthesized sequence
atggctggcgcgctgcg

SEQ ID NO: 3970 - DNA, 17 bp, Artificial sequence
  Synthesized sequence
gtggcgaccaccttgtt

SEQ ID NO: 3971 - DNA, 17 bp, Artificial sequence
  Synthesized sequence
ctggcggtggtgttgaa

SEQ ID NO: 3972 - DNA, 17 bp, Artificial sequence
  Synthesized sequence
agggcattcaagtggct

SEQ ID NO: 3973 - DNA, 17 bp, Artificial sequence
  Synthesized sequence
agggcattcaagtggct

SEQ ID NO: 3974 - DNA, 17 bp, Artificial sequence
  Synthesized sequence
ccggcccgctacctgcg

SEQ ID NO: 3975 - DNA, 17 bp, Artificial sequence
  Synthesized sequence
ctggaattgccgctgcc

SEQ ID NO: 3976 - DNA, 17 bp, Artificial sequence
  Synthesized sequence
ctggcgccgcagccgct

SEQ ID NO: 3977 - DNA, 17 bp, Artificial sequence
  Synthesized sequence
ctggaatcggtgctgcg

SEQ ID NO: 3978 - DNA, 17 bp, Artificial sequence
  Synthesized sequence
aagtaacgcaggttgct

SEQ ID NO: 3979 - DNA, 17 bp, Artificial sequence
  Synthesized sequence
tcggcaccctgctcgcc

SEQ ID NO: 3980 - DNA, 17 bp, Artificial sequence
  Synthesized sequence
ggggcaccatgctcgcc

SEQ ID NO: 3981 - DNA, 17 bp, Artificial sequence
  Synthesized sequence
gtcgaacaacgcctgca

SEQ ID NO: 3982 - DNA, 17 bp, Artificial sequence
  Synthesized sequence
ctgcaacgcctgtttca

SEQ ID NO: 3983 - DNA, 17 bp, Artificial sequence
  Synthesized sequence
ttgccgggtggattgct

SEQ ID NO: 3984 - DNA, 17 bp, Artificial sequence
  Synthesized sequence
atgacccaccgcgtgct

SEQ ID NO: 3985 - DNA, 17 bp, Artificial sequence
  Synthesized sequence
caggcacgactggcgcc

SEQ ID NO: 3986 - DNA, 17 bp, Artificial sequence
  Synthesized sequence
tcggtccgacctttgcc

SEQ ID NO: 3987 - DNA, 17 bp, Artificial sequence
  Synthesized sequence
agggctggctgcttgcg

SEQ ID NO: 3988 - DNA, 17 bp, Artificial sequence
  Synthesized sequence
ccggcaagaccctggcc

SEQ ID NO: 3989 - DNA, 17 bp, Artificial sequence
  Synthesized sequence
gtggtgctgggcgtgca

SEQ ID NO: 3990 - DNA, 17 bp, Artificial sequence
  Synthesized sequence
ctggcgcaggtggtgga

SEQ ID NO: 3991 - DNA, 17 bp, Artificial sequence
  Synthesized sequence
ctcgccctgatcctgct

SEQ ID NO: 3992 - DNA, 17 bp, Artificial sequence
  Synthesized sequence
ttggatcaattgtagca

SEQ ID NO: 3993 - DNA, 17 bp, Artificial sequence
  Synthesized sequence
atggcccacagcctgaa

SEQ ID NO: 3994 - DNA, 17 bp, Artificial sequence
  Synthesized sequence
cgagcattggtgttgca

SEQ ID NO: 3995 - DNA, 17 bp, Artificial sequence
  Synthesized sequence
ctcgaagggccgttgcg

SEQ ID NO: 3996 - DNA, 17 bp, Artificial sequence
  Synthesized sequence
gttgcaaagggtctgca

SEQ ID NO: 3997 - DNA, 17 bp, Artificial sequence
  Synthesized sequence
agggcatggctcatgga

SEQ ID NO: 3998 - DNA, 17 bp, Artificial sequence
  Synthesized sequence
ctggtaccggacaagct

SEQ ID NO: 3999 - DNA, 17 bp, Artificial sequence
  Synthesized sequence
atggcgcgcctgcggcg

SEQ ID NO: 4000 - DNA, 17 bp, Artificial sequence
  Synthesized sequence
ctggcaggccctgcgcc

SEQ ID NO: 4001 - DNA, 17 bp, Artificial sequence
  Synthesized sequence
ctggcagggacagttcg

SEQ ID NO: 4002 - DNA, 17 bp, Artificial sequence
  Synthesized sequence
ctggaacgcctgctggc

SEQ ID NO: 4003 - DNA, 17 bp, Artificial sequence
  Synthesized sequence
ctggtgggccgcctgct

SEQ ID NO: 4004 - DNA, 17 bp, Artificial sequence
  Synthesized sequence
ctggcccaggagctgtt

SEQ ID NO: 4005 - DNA, 17 bp, Artificial sequence
  Synthesized sequence
ctggccgaggatctgcg

SEQ ID NO: 4006 - DNA, 17 bp, Artificial sequence
  Synthesized sequence
ctggcagatcgacggca

SEQ ID NO: 4007 - DNA, 17 bp, Artificial sequence
  Synthesized sequence
ctggcaccgccgtaccc

SEQ ID NO: 4008 - DNA, 17 bp, Artificial sequence
  Synthesized sequence
ttcgcccggggctttct

SEQ ID NO: 4009 - DNA, 17 bp, Artificial sequence
  Synthesized sequence
ctgccacggccctgcct

SEQ ID NO: 4010 - DNA, 17 bp, Artificial sequence
  Synthesized sequence
gtggtgctcaccatgct

SEQ ID NO: 4011 - DNA, 17 bp, Artificial sequence
  Synthesized sequence
tgggtacgtggctggct

SEQ ID NO: 4012 - DNA, 17 bp, Artificial sequence
  Synthesized sequence
ttgatccagtccttgca

SEQ ID NO: 4013 - DNA, 17 bp, Artificial sequence
  Synthesized sequence
atggcccggcgcaggcg

SEQ ID NO: 4014 - DNA, 17 bp, Artificial sequence
  Synthesized sequence
agggccaccgacttgct

SEQ ID NO: 4015 - DNA, 17 bp, Artificial sequence
  Synthesized sequence
gtgggtcgtttcatgcg

SEQ ID NO: 4016 - DNA, 17 bp, Artificial sequence
  Synthesized sequence
ttggcaaggaactcggc

SEQ ID NO: 4017 - DNA, 17 bp, Artificial sequence
  Synthesized sequence
atggctctcgcctggcc

SEQ ID NO: 4018 - DNA, 17 bp, Artificial sequence
  Synthesized sequence
gtggtgcaggggttgat

SEQ ID NO: 4019 - DNA, 17 bp, Artificial sequence
  Synthesized sequence
ctggctcaactgatcca

SEQ ID NO: 4020 - DNA, 17 bp, Artificial sequence
  Synthesized sequence
gtagcatggtccttgtg

SEQ ID NO: 4021 - DNA, 17 bp, Artificial sequence
  Synthesized sequence
atggccggtcgcgtgcc

SEQ ID NO: 4022 - DNA, 17 bp, Artificial sequence
  Synthesized sequence
ctggcgcagaagatgta

SEQ ID NO: 4023 - DNA, 17 bp, Artificial sequence
  Synthesized sequence
gtggcgcctcgcttgtg

SEQ ID NO: 4024 - DNA, 17 bp, Artificial sequence
  Synthesized sequence
ttgacacgccgaacgct

SEQ ID NO: 4025 - DNA, 17 bp, Artificial sequence
  Synthesized sequence
ctgccgcaactggtgca

SEQ ID NO: 4026 - DNA, 17 bp, Artificial sequence
  Synthesized sequence
gtggcctgaagttttcc

SEQ ID NO: 4027 - DNA, 17 bp, Artificial sequence
  Synthesized sequence
ctgggatggccggggct

SEQ ID NO: 4028 - DNA, 17 bp, Artificial sequence
  Synthesized sequence
gtggcgcgccagccgcg

SEQ ID NO: 4029 - DNA, 17 bp, Artificial sequence
  Synthesized sequence
gtggcgcgccagccgcg

SEQ ID NO: 4030 - DNA, 17 bp, Artificial sequence
  Synthesized sequence
aaggcacagccgctggt

SEQ ID NO: 4031 - DNA, 17 bp, Artificial sequence
  Synthesized sequence
ctggccaggaagttggc

SEQ ID NO: 4032 - DNA, 17 bp, Artificial sequence
  Synthesized sequence
ctggcgcggcagcggcg

SEQ ID NO: 4033 - DNA, 17 bp, Artificial sequence
  Synthesized sequence
gggggacgtggcgtgca

SEQ ID NO: 4034 - DNA, 17 bp, Artificial sequence
  Synthesized sequence
gcggcacgggtgttcaa

SEQ ID NO: 4035 - DNA, 17 bp, Artificial sequence
  Synthesized sequence
gtggaacgctggctgga

SEQ ID NO: 4036 - DNA, 17 bp, Artificial sequence
  Synthesized sequence
gtggggcgcgggtggca

SEQ ID NO: 4037 - DNA, 17 bp, Artificial sequence
  Synthesized sequence
ctggcggcgcgcttgta

SEQ ID NO: 4038 - DNA, 17 bp, Artificial sequence
  Synthesized sequence
ccggcacgccgggtaca

SEQ ID NO: 4039 - DNA, 17 bp, Artificial sequence
  Synthesized sequence
ccggcacgccgggtaca

SEQ ID NO: 4040 - DNA, 17 bp, Artificial sequence
  Synthesized sequence
atcgcgcagcccatgca

SEQ ID NO: 4041 - DNA, 17 bp, Artificial sequence
  Synthesized sequence
tcggcccggtgcgtgcc

SEQ ID NO: 4042 - DNA, 17 bp, Artificial sequence
  Synthesized sequence
gtggcgtgccgccggct

SEQ ID NO: 4043 - DNA, 17 bp, Artificial sequence
  Synthesized sequence
ctggcaccctggctggg

SEQ ID NO: 4044 - DNA, 17 bp, Artificial sequence
  Synthesized sequence
ctggctgggcgtttccg

SEQ ID NO: 4045 - DNA, 17 bp, Artificial sequence
  Synthesized sequence
ctggcgctggtgccgct

SEQ ID NO: 4046 - DNA, 17 bp, Artificial sequence
  Synthesized sequence
ttcgccctgttcgtgct

SEQ ID NO: 4047 - DNA, 17 bp, Artificial sequence
  Synthesized sequence
ctgccgcggcggttgta

SEQ ID NO: 4048 - DNA, 17 bp, Artificial sequence
  Synthesized sequence
ctgcggcgggctttgca

SEQ ID NO: 4049 - DNA, 17 bp, Artificial sequence
  Synthesized sequence
atggcgaagcgctggcg

SEQ ID NO: 4050 - DNA, 17 bp, Artificial sequence
  Synthesized sequence
ctgccttgacgtttgcc

SEQ ID NO: 4051 - DNA, 17 bp, Artificial sequence
  Synthesized sequence
gtgccagggtgcctgcg

SEQ ID NO: 4052 - DNA, 17 bp, Artificial sequence
  Synthesized sequence
gtggagccggacctgca

SEQ ID NO: 4053 - DNA, 17 bp, Artificial sequence
  Synthesized sequence
atgcccaaggcgttgca

SEQ ID NO: 4054 - DNA, 17 bp, Artificial sequence
  Synthesized sequence
ctggtcgggccggtgct

SEQ ID NO: 4055 - DNA, 17 bp, Artificial sequence
  Synthesized sequence
ctggcgcggtccgggcg

SEQ ID NO: 4056 - DNA, 17 bp, Artificial sequence
  Synthesized sequence
ctggtgcccgtgatgca

SEQ ID NO: 4057 - DNA, 17 bp, Artificial sequence
  Synthesized sequence
gtggcgaaatgatggca

SEQ ID NO: 4058 - DNA, 17 bp, Artificial sequence
  Synthesized sequence
ccggcatcgaacttcca

SEQ ID NO: 4059 - DNA, 17 bp, Artificial sequence
  Synthesized sequence
ctgggcagcatgctgct

SEQ ID NO: 4060 - DNA, 17 bp, Artificial sequence
  Synthesized sequence
ctggcagaattatacct

SEQ ID NO: 4061 - DNA, 17 bp, Artificial sequence
  Synthesized sequence
ctcggccagttgttgca

SEQ ID NO: 4062 - DNA, 17 bp, Artificial sequence
  Synthesized sequence
atggcgccgcacgagct

SEQ ID NO: 4063 - DNA, 17 bp, Artificial sequence
  Synthesized sequence
atggcaaatgcccggct

SEQ ID NO: 4064 - DNA, 17 bp, Artificial sequence
  Synthesized sequence
ttcgcccggcacctgcc

SEQ ID NO: 4065 - DNA, 17 bp, Artificial sequence
  Synthesized sequence
ttggaagatgcgctgca

SEQ ID NO: 4066 - DNA, 17 bp, Artificial sequence
  Synthesized sequence
atggcctagccgtggcc

SEQ ID NO: 4067 - DNA, 17 bp, Artificial sequence
  Synthesized sequence
ctggcggtcgagctgct

SEQ ID NO: 4068 - DNA, 17 bp, Artificial sequence
  Synthesized sequence
ctggagcgcgacctgcg

SEQ ID NO: 4069 - DNA, 17 bp, Artificial sequence
  Synthesized sequence
gcggcacatcgtttccc

SEQ ID NO: 4070 - DNA, 17 bp, Artificial sequence
  Synthesized sequence
gcggtccgacctttgcc

SEQ ID NO: 4071 - DNA, 17 bp, Artificial sequence
  Synthesized sequence
gtggctttgcgcctgcc

SEQ ID NO: 4072 - DNA, 17 bp, Artificial sequence
  Synthesized sequence
ctggacgagcagttgcc

SEQ ID NO: 4073 - DNA, 17 bp, Artificial sequence
  Synthesized sequence
ctggctggcgctctgcg

SEQ ID NO: 4074 - DNA, 17 bp, Artificial sequence
  Synthesized sequence
ctggcgagctgggtgcc

SEQ ID NO: 4075 - DNA, 17 bp, Artificial sequence
  Synthesized sequence
ctggcggatgactggct

SEQ ID NO: 4076 - DNA, 17 bp, Artificial sequence
  Synthesized sequence
atggcgtgctgctttcc

SEQ ID NO: 4077 - DNA, 17 bp, Artificial sequence
  Synthesized sequence
ctggaaggcgtgttggg

SEQ ID NO: 4078 - DNA, 17 bp, Artificial sequence
  Synthesized sequence
ctggcctggcgcctgtt

SEQ ID NO: 4079 - DNA, 17 bp, Artificial sequence
  Synthesized sequence
ctggctcaacggcggct

SEQ ID NO: 4080 - DNA, 17 bp, Artificial sequence
  Synthesized sequence
atggaaaacgccttgga

SEQ ID NO: 4081 - DNA, 17 bp, Artificial sequence
  Synthesized sequence
aaggcacggcccccgcc

SEQ ID NO: 4082 - DNA, 17 bp, Artificial sequence
  Synthesized sequence
acggcatggtgatcgcc

SEQ ID NO: 4083 - DNA, 17 bp, Artificial sequence
  Synthesized sequence
ctggggcggctgttccg

SEQ ID NO: 4084 - DNA, 17 bp, Artificial sequence
  Synthesized sequence
acggcaaggtgaatgcc

SEQ ID NO: 4085 - DNA, 17 bp, Artificial sequence
  Synthesized sequence
gtggccagcgtcttccg

SEQ ID NO: 4086 - DNA, 17 bp, Artificial sequence
  Synthesized sequence
ctggaacagggcctgga

SEQ ID NO: 4087 - DNA, 17 bp, Artificial sequence
  Synthesized sequence
gcggccctggccctgct

SEQ ID NO: 4088 - DNA, 17 bp, Artificial sequence
  Synthesized sequence
ctggccctgctgcagca

SEQ ID NO: 4089 - DNA, 17 bp, Artificial sequence
  Synthesized sequence
ccggcgtgggtgatgct

SEQ ID NO: 4090 - DNA, 17 bp, Artificial sequence
  Synthesized sequence
gtcgccctgctggtgct

SEQ ID NO: 4091 - DNA, 17 bp, Artificial sequence
  Synthesized sequence
atggcatcccgactgga

SEQ ID NO: 4092 - DNA, 17 bp, Artificial sequence
  Synthesized sequence
ctggcgcgtccgtcggt

SEQ ID NO: 4093 - DNA, 17 bp, Artificial sequence
  Synthesized sequence
ccggcgccgatgatgca

SEQ ID NO: 4094 - DNA, 17 bp, Artificial sequence
  Synthesized sequence
ttgggacacgtgcagca

SEQ ID NO: 4095 - DNA, 17 bp, Artificial sequence
  Synthesized sequence
cgggaagcccagttgct

SEQ ID NO: 4096 - DNA, 17 bp, Artificial sequence
  Synthesized sequence
gtggcacataactaccc

SEQ ID NO: 4097 - DNA, 17 bp, Artificial sequence
  Synthesized sequence
ctgggaggcgatctgcc

SEQ ID NO: 4098 - DNA, 17 bp, Artificial sequence
  Synthesized sequence
tggccatggccattgcc

SEQ ID NO: 4099 - DNA, 17 bp, Artificial sequence
  Synthesized sequence
ctgtcgcggaccttcca

SEQ ID NO: 4100 - DNA, 17 bp, Artificial sequence
  Synthesized sequence
cgggcagtccatgtgct

SEQ ID NO: 4101 - DNA, 17 bp, Artificial sequence
  Synthesized sequence
ggggcacagaaaaagct

SEQ ID NO: 4102 - DNA, 17 bp, Artificial sequence
  Synthesized sequence
tcggcacgagaaaggca

SEQ ID NO: 4103 - DNA, 17 bp, Artificial sequence
  Synthesized sequence
atggcgcagatctacca

SEQ ID NO: 4104 - DNA, 17 bp, Artificial sequence
  Synthesized sequence
gcggccggggcattgcc

SEQ ID NO: 4105 - DNA, 17 bp, Artificial sequence
  Synthesized sequence
ctgccagcgcccctgca

SEQ ID NO: 4106 - DNA, 17 bp, Artificial sequence
  Synthesized sequence
acgggaaacgaattgca

SEQ ID NO: 4107 - DNA, 17 bp, Artificial sequence
  Synthesized sequence
cgggcacggttcgggcg

SEQ ID NO: 4108 - DNA, 17 bp, Artificial sequence
  Synthesized sequence
ctgacgcatctgctgct

SEQ ID NO: 4109 - DNA, 17 bp, Artificial sequence
  Synthesized sequence
gtggtccagcgtttcca

SEQ ID NO: 4110 - DNA, 17 bp, Artificial sequence
  Synthesized sequence
accgcaaggcccttgcc

SEQ ID NO: 4111 - DNA, 17 bp, Artificial sequence
  Synthesized sequence
gtggcatgcccgatacc

SEQ ID NO: 4112 - DNA, 17 bp, Artificial sequence
  Synthesized sequence
ctggggcaggtgttcca

SEQ ID NO: 4113 - DNA, 17 bp, Artificial sequence
  Synthesized sequence
atggtccggcctttgtg

SEQ ID NO: 4114 - DNA, 17 bp, Artificial sequence
  Synthesized sequence
ctgggcgaccgcttgcg

SEQ ID NO: 4115 - DNA, 17 bp, Artificial sequence
  Synthesized sequence
atgacgccgctgatgct

SEQ ID NO: 4116 - DNA, 17 bp, Artificial sequence
  Synthesized sequence
cgggcaggccgactgcg

SEQ ID NO: 4117 - DNA, 17 bp, Artificial sequence
  Synthesized sequence
ttggagctgcgaatgct

SEQ ID NO: 4118 - DNA, 17 bp, Artificial sequence
  Synthesized sequence
ccggcaaggacatcgcc

SEQ ID NO: 4119 - DNA, 17 bp, Artificial sequence
  Synthesized sequence
atggccgcgcacctgcg

SEQ ID NO: 4120 - DNA, 17 bp, Artificial sequence
  Synthesized sequence
ctggaaagcgagctgcc

SEQ ID NO: 4121 - DNA, 17 bp, Artificial sequence
  Synthesized sequence
ctgacgcggagtttgat

SEQ ID NO: 4122 - DNA, 17 bp, Artificial sequence
  Synthesized sequence
tgggcaagaccctcgcc

SEQ ID NO: 4123 - DNA, 17 bp, Artificial sequence
  Synthesized sequence
ccggccagggcgttgcc

SEQ ID NO: 4124 - DNA, 17 bp, Artificial sequence
  Synthesized sequence
ctggcgcggcaagagcg

SEQ ID NO: 4125 - DNA, 17 bp, Artificial sequence
  Synthesized sequence
gtggtatagagattgag

SEQ ID NO: 4126 - DNA, 17 bp, Artificial sequence
  Synthesized sequence
agggcccggtgcatgcg

SEQ ID NO: 4127 - DNA, 17 bp, Artificial sequence
  Synthesized sequence
gtggcgcggtatcggcg

SEQ ID NO: 4128 - DNA, 17 bp, Artificial sequence
  Synthesized sequence
gtcgctccgctgctgct

SEQ ID NO: 4129 - DNA, 17 bp, Artificial sequence
  Synthesized sequence
ccggcaggacttttccg

SEQ ID NO: 4130 - DNA, 17 bp, Artificial sequence
  Synthesized sequence
cgggcccaggcctcgct

SEQ ID NO: 4131 - DNA, 17 bp, Artificial sequence
  Synthesized sequence
gtggccatcgcgctgct

SEQ ID NO: 4132 - DNA, 17 bp, Artificial sequence
  Synthesized sequence
gtgggccaggtttttca

SEQ ID NO: 4133 - DNA, 17 bp, Artificial sequence
  Synthesized sequence
gcggcaggcgtttggcg

SEQ ID NO: 4134 - DNA, 17 bp, Artificial sequence
  Synthesized sequence
acggcaaggccgtcgcc

SEQ ID NO: 4135 - DNA, 17 bp, Artificial sequence
  Synthesized sequence
ctggccttgcctgtgcc

SEQ ID NO: 4136 - DNA, 17 bp, Artificial sequence
  Synthesized sequence
ctggccgggcccgcgct

SEQ ID NO: 4137 - DNA, 17 bp, Artificial sequence
  Synthesized sequence
ctggtcctcgacctgct

SEQ ID NO: 4138 - DNA, 17 bp, Artificial sequence
  Synthesized sequence
gaggccggcaggttgcg

SEQ ID NO: 4139 - DNA, 17 bp, Artificial sequence
  Synthesized sequence
ctggaatgccacctggt

SEQ ID NO: 4140 - DNA, 17 bp, Artificial sequence
  Synthesized sequence
ttggcgcgggcttccca

SEQ ID NO: 4141 - DNA, 17 bp, Artificial sequence
  Synthesized sequence
ttggcccgccagccgcg

SEQ ID NO: 4142 - DNA, 17 bp, Artificial sequence
  Synthesized sequence
ctgggtagggtcctgca

SEQ ID NO: 4143 - DNA, 17 bp, Artificial sequence
  Synthesized sequence
ctgacccgctttttcct

SEQ ID NO: 4144 - DNA, 17 bp, Artificial sequence
  Synthesized sequence
ctgacccgctttttcct

SEQ ID NO: 4145 - DNA, 17 bp, Artificial sequence
  Synthesized sequence
gtggccaacgtattcca

SEQ ID NO: 4146 - DNA, 17 bp, Artificial sequence
  Synthesized sequence
acgacacgatccgtgca

SEQ ID NO: 4147 - DNA, 17 bp, Artificial sequence
  Synthesized sequence
ttggcatcctgccagca

SEQ ID NO: 4148 - DNA, 17 bp, Artificial sequence
  Synthesized sequence
tcggcgctggtactgct

SEQ ID NO: 4149 - DNA, 17 bp, Artificial sequence
  Synthesized sequence
gtggcaatgctgtgtct

SEQ ID NO: 4150 - DNA, 17 bp, Artificial sequence
  Synthesized sequence
caggcacggatgccgcg

SEQ ID NO: 4151 - DNA, 17 bp, Artificial sequence
  Synthesized sequence
atggccgacaacctgcc

SEQ ID NO: 4152 - DNA, 17 bp, Artificial sequence
  Synthesized sequence
cttgcgcagccactgca

SEQ ID NO: 4153 - DNA, 17 bp, Artificial sequence
  Synthesized sequence
ttggcaggatccgtggg

SEQ ID NO: 4154 - DNA, 17 bp, Artificial sequence
  Synthesized sequence
ctggcctggaacctgtt

SEQ ID NO: 4155 - DNA, 17 bp, Artificial sequence
  Synthesized sequence
gttgcacgctttctgaa

SEQ ID NO: 4156 - DNA, 17 bp, Artificial sequence
  Synthesized sequence
cgggcgcaggcctcgct

SEQ ID NO: 4157 - DNA, 17 bp, Artificial sequence
  Synthesized sequence
atggcgcggcagaagcg

SEQ ID NO: 4158 - DNA, 17 bp, Artificial sequence
  Synthesized sequence
atgacgcggacattgat

SEQ ID NO: 4159 - DNA, 17 bp, Artificial sequence
  Synthesized sequence
ctggcctggcgacggct

SEQ ID NO: 4160 - DNA, 17 bp, Artificial sequence
  Synthesized sequence
ctgccgcgcagctggct

SEQ ID NO: 4161 - DNA, 17 bp, Artificial sequence
  Synthesized sequence
atggcgcgactacggcc

SEQ ID NO: 4162 - DNA, 17 bp, Artificial sequence
  Synthesized sequence
gtggcgcgaccgttcaa

SEQ ID NO: 4163 - DNA, 17 bp, Artificial sequence
  Synthesized sequence
cgcgcaagcatcttgcg

SEQ ID NO: 4164 - DNA, 17 bp, Artificial sequence
  Synthesized sequence
atggcagcatccgtggt

SEQ ID NO: 4165 - DNA, 17 bp, Artificial sequence
  Synthesized sequence
atggcagcatccgtggt

SEQ ID NO: 4166 - DNA, 17 bp, Artificial sequence
  Synthesized sequence
ctcgcagtggtctcgct

SEQ ID NO: 4167 - DNA, 17 bp, Artificial sequence
  Synthesized sequence
ttgggaaccaccttgat

SEQ ID NO: 4168 - DNA, 17 bp, Artificial sequence
  Synthesized sequence
ccggcgcgacgcctgcc

SEQ ID NO: 4169 - DNA, 17 bp, Artificial sequence
  Synthesized sequence
ctggccctgcaacggct

SEQ ID NO: 4170 - DNA, 17 bp, Artificial sequence
  Synthesized sequence
caggcgcagcagttgtt

SEQ ID NO: 4171 - DNA, 17 bp, Artificial sequence
  Synthesized sequence
gtggggcgtacgtggca

SEQ ID NO: 4172 - DNA, 17 bp, Artificial sequence
  Synthesized sequence
ctggcaacggctacgct

SEQ ID NO: 4173 - DNA, 17 bp, Artificial sequence
  Synthesized sequence
gcggcggcggcgttgct

SEQ ID NO: 4174 - DNA, 17 bp, Artificial sequence
  Synthesized sequence
ctggctcggcagcagcg

SEQ ID NO: 4175 - DNA, 17 bp, Artificial sequence
  Synthesized sequence
ccggcgctgatgctgca

SEQ ID NO: 4176 - DNA, 17 bp, Artificial sequence
  Synthesized sequence
ctggcctcgaccatgcc

SEQ ID NO: 4177 - DNA, 17 bp, Artificial sequence
  Synthesized sequence
gcggctcgcctggtgcc

SEQ ID NO: 4178 - DNA, 17 bp, Artificial sequence
  Synthesized sequence
ctgccgcacctgtcgct

SEQ ID NO: 4179 - DNA, 17 bp, Artificial sequence
  Synthesized sequence
agggcacgaagctgtct

SEQ ID NO: 4180 - DNA, 17 bp, Artificial sequence
  Synthesized sequence
ctggccgaagcgttgaa

SEQ ID NO: 4181 - DNA, 17 bp, Artificial sequence
  Synthesized sequence
ctggccgcagtgtcgca

SEQ ID NO: 4182 - DNA, 17 bp, Artificial sequence
  Synthesized sequence
ctggccgaggatctgcg

SEQ ID NO: 4183 - DNA, 17 bp, Artificial sequence
  Synthesized sequence
gtggtacattacccgca

SEQ ID NO: 4184 - DNA, 17 bp, Artificial sequence
  Synthesized sequence
gttgcacgcctgtcgta

SEQ ID NO: 4185 - DNA, 17 bp, Artificial sequence
  Synthesized sequence
ttcgcatacggttggca

SEQ ID NO: 4186 - DNA, 17 bp, Artificial sequence
  Synthesized sequence
gtggcgcagagctacct

SEQ ID NO: 4187 - DNA, 17 bp, Artificial sequence
  Synthesized sequence
ttcgtcccgcagttgct

SEQ ID NO: 4188 - DNA, 17 bp, Artificial sequence
  Synthesized sequence
ttggcgagctgatggcg

SEQ ID NO: 4189 - DNA, 17 bp, Artificial sequence
  Synthesized sequence
ccggcgcagcccctgcc

SEQ ID NO: 4190 - DNA, 17 bp, Artificial sequence
  Synthesized sequence
gaggatcgccagttgcc

SEQ ID NO: 4191 - DNA, 17 bp, Artificial sequence
  Synthesized sequence
ctggccgaaggcgtgcg

SEQ ID NO: 4192 - DNA, 17 bp, Artificial sequence
  Synthesized sequence
ccggaacacgcctggct

SEQ ID NO: 4193 - DNA, 17 bp, Artificial sequence
  Synthesized sequence
ttggcagtcggcctgtt

SEQ ID NO: 4194 - DNA, 17 bp, Artificial sequence
  Synthesized sequence
agggaaagcgtcatgct

SEQ ID NO: 4195 - DNA, 17 bp, Artificial sequence
  Synthesized sequence
ctggcgcagggggcgca

SEQ ID NO: 4196 - DNA, 17 bp, Artificial sequence
  Synthesized sequence
gtgcgtcgcgggttgct

SEQ ID NO: 4197 - DNA, 17 bp, Artificial sequence
  Synthesized sequence
atggcaaaggacctgac

SEQ ID NO: 4198 - DNA, 17 bp, Artificial sequence
  Synthesized sequence
tcgggctggtctttgct

SEQ ID NO: 4199 - DNA, 17 bp, Artificial sequence
  Synthesized sequence
ctggcgccggacatgtt

SEQ ID NO: 4200 - DNA, 17 bp, Artificial sequence
  Synthesized sequence
ctggctgttgacctgca

SEQ ID NO: 4201 - DNA, 17 bp, Artificial sequence
  Synthesized sequence
atggcgcgacatgagcg

SEQ ID NO: 4202 - DNA, 17 bp, Artificial sequence
  Synthesized sequence
ctggcgcgacggccgcc

SEQ ID NO: 4203 - DNA, 17 bp, Artificial sequence
  Synthesized sequence
ttcgccccggtgatgct

SEQ ID NO: 4204 - DNA, 17 bp, Artificial sequence
  Synthesized sequence
caggcacagaactggga

SEQ ID NO: 4205 - DNA, 17 bp, Artificial sequence
  Synthesized sequence
ctggcgctcgggttggc

SEQ ID NO: 4206 - DNA, 17 bp, Artificial sequence
  Synthesized sequence
cgggcgccacgcgtgca

SEQ ID NO: 4207 - DNA, 17 bp, Artificial sequence
  Synthesized sequence
ctggcggcgcgcctgcc

SEQ ID NO: 4208 - DNA, 17 bp, Artificial sequence
  Synthesized sequence
ctggtatccaagctgcc

SEQ ID NO: 4209 - DNA, 17 bp, Artificial sequence
  Synthesized sequence
aaggcaagccgttggcc

SEQ ID NO: 4210 - DNA, 17 bp, Artificial sequence
  Synthesized sequence
tgggcaaggtctttccg

SEQ ID NO: 4211 - DNA, 17 bp, Artificial sequence
  Synthesized sequence
ctggcagtacgacggca

SEQ ID NO: 4212 - DNA, 17 bp, Artificial sequence
  Synthesized sequence
ctggtcctggcgtcgct

SEQ ID NO: 4213 - DNA, 17 bp, Artificial sequence
  Synthesized sequence
ttcgccctgaccctgct

SEQ ID NO: 4214 - DNA, 17 bp, Artificial sequence
  Synthesized sequence
gtcgtagaagggttgca

SEQ ID NO: 4215 - DNA, 17 bp, Artificial sequence
  Synthesized sequence
ctcgcatatcggttgat

SEQ ID NO: 4216 - DNA, 17 bp, Artificial sequence
  Synthesized sequence
ctcgcctggcgcctgca

SEQ ID NO: 4217 - DNA, 17 bp, Artificial sequence
  Synthesized sequence
atggcgctgctggtgga

SEQ ID NO: 4218 - DNA, 17 bp, Artificial sequence
  Synthesized sequence
ggggcatttctgttcca

SEQ ID NO: 4219 - DNA, 17 bp, Artificial sequence
  Synthesized sequence
tgggcatgtcctttgtc

SEQ ID NO: 4220 - DNA, 17 bp, Artificial sequence
  Synthesized sequence
caggcacagggccggca

SEQ ID NO: 4221 - DNA, 17 bp, Artificial sequence
  Synthesized sequence
ttggcgctgtccgggct

SEQ ID NO: 4222 - DNA, 17 bp, Artificial sequence
  Synthesized sequence
ccggcgcgaacgctgcc

SEQ ID NO: 4223 - DNA, 17 bp, Artificial sequence
  Synthesized sequence
atcgcccaggccatgca

SEQ ID NO: 4224 - DNA, 17 bp, Artificial sequence
  Synthesized sequence
ctggcgccagggttggc

SEQ ID NO: 4225 - DNA, 17 bp, Artificial sequence
  Synthesized sequence
gcggccttgccgttgcc

SEQ ID NO: 4226 - DNA, 17 bp, Artificial sequence
  Synthesized sequence
gcggcccggcgatcgcc

SEQ ID NO: 4227 - DNA, 17 bp, Artificial sequence
  Synthesized sequence
ccggcggtctggttgct

SEQ ID NO: 4228 - DNA, 17 bp, Artificial sequence
  Synthesized sequence
gtgggcggccaactgct

SEQ ID NO: 4229 - DNA, 17 bp, Artificial sequence
  Synthesized sequence
ctggaacgcatggtggc

SEQ ID NO: 4230 - DNA, 17 bp, Artificial sequence
  Synthesized sequence
atggacggcctgtcgct

SEQ ID NO: 4231 - DNA, 17 bp, Artificial sequence
  Synthesized sequence
ctgcgccggcccttgcc

SEQ ID NO: 4232 - DNA, 17 bp, Artificial sequence
  Synthesized sequence
aaggccagccccatgct

SEQ ID NO: 4233 - DNA, 17 bp, Artificial sequence
  Synthesized sequence
ctgaaaagccccttgcc

SEQ ID NO: 4234 - DNA, 17 bp, Artificial sequence
  Synthesized sequence
aaggcgccgacgctgct

SEQ ID NO: 4235 - DNA, 17 bp, Artificial sequence
  Synthesized sequence
ctgacccagaacttcct

SEQ ID NO: 4236 - DNA, 17 bp, Artificial sequence
  Synthesized sequence
atgacatggacctttcc

SEQ ID NO: 4237 - DNA, 17 bp, Artificial sequence
  Synthesized sequence
ctggcgccggtgatgat

SEQ ID NO: 4238 - DNA, 17 bp, Artificial sequence
  Synthesized sequence
gcggcatgtccatcgcc

SEQ ID NO: 4239 - DNA, 17 bp, Artificial sequence
  Synthesized sequence
ctggcgcgggagcagcg

SEQ ID NO: 4240 - DNA, 17 bp, Artificial sequence
  Synthesized sequence
ctggaagacccctggcg

SEQ ID NO: 4241 - DNA, 17 bp, Artificial sequence
  Synthesized sequence
cagggccagcttttgcc

SEQ ID NO: 4242 - DNA, 17 bp, Artificial sequence
  Synthesized sequence
gtgggacgagggtcgga

SEQ ID NO: 4243 - DNA, 17 bp, Artificial sequence
  Synthesized sequence
aggccacgggcatcgct

SEQ ID NO: 4244 - DNA, 17 bp, Artificial sequence
  Synthesized sequence
atggccgcactggtgcg

SEQ ID NO: 4245 - DNA, 17 bp, Artificial sequence
  Synthesized sequence
ctggcgcccctgctcct

SEQ ID NO: 4246 - DNA, 17 bp, Artificial sequence
  Synthesized sequence
gtggaactgccggtggt

SEQ ID NO: 4247 - DNA, 17 bp, Artificial sequence
  Synthesized sequence
ctggccgattgatagca

SEQ ID NO: 4248 - DNA, 17 bp, Artificial sequence
  Synthesized sequence
gcggcacaggcggtgtt

SEQ ID NO: 4249 - DNA, 17 bp, Artificial sequence
  Synthesized sequence
cccgcactgtcattgcc

SEQ ID NO: 4250 - DNA, 17 bp, Artificial sequence
  Synthesized sequence
atggtgatgccgttgcg

SEQ ID NO: 4251 - DNA, 17 bp, Artificial sequence
  Synthesized sequence
ctggcctggaccgagca

SEQ ID NO: 4252 - DNA, 17 bp, Artificial sequence
  Synthesized sequence
ttgccgcacggcctgct

SEQ ID NO: 4253 - DNA, 17 bp, Artificial sequence
  Synthesized sequence
atcgcctgcctgctgct

SEQ ID NO: 4254 - DNA, 17 bp, Artificial sequence
  Synthesized sequence
ttggcattgatgctgtc

SEQ ID NO: 4255 - DNA, 17 bp, Artificial sequence
  Synthesized sequence
ctcgaaccgcagatgct

SEQ ID NO: 4256 - DNA, 17 bp, Artificial sequence
  Synthesized sequence
atggcgctggtcatcct

SEQ ID NO: 4257 - DNA, 17 bp, Artificial sequence
  Synthesized sequence
ctggacctggttttgta

SEQ ID NO: 4258 - DNA, 17 bp, Artificial sequence
  Synthesized sequence
ctggtcggcggcctgct

SEQ ID NO: 4259 - DNA, 17 bp, Artificial sequence
  Synthesized sequence
atggcacccggagtggc

SEQ ID NO: 4260 - DNA, 17 bp, Artificial sequence
  Synthesized sequence
ctggaacacgccgggca

SEQ ID NO: 4261 - DNA, 17 bp, Artificial sequence
  Synthesized sequence
ctggtacgacgacagcg

SEQ ID NO: 4262 - DNA, 17 bp, Artificial sequence
  Synthesized sequence
ctggaacaggcggtcct

SEQ ID NO: 4263 - DNA, 17 bp, Artificial sequence
  Synthesized sequence
ctgccaccgtcgtagcg

SEQ ID NO: 4264 - DNA, 17 bp, Artificial sequence
  Synthesized sequence
ccggcaagatcttcgcc

SEQ ID NO: 4265 - DNA, 17 bp, Artificial sequence
  Synthesized sequence
ctggcaaagagcttcga

SEQ ID NO: 4266 - DNA, 17 bp, Artificial sequence
  Synthesized sequence
ccggctcggcgctggcc

SEQ ID NO: 4267 - DNA, 17 bp, Artificial sequence
  Synthesized sequence
atcgcgctggtcatgct

SEQ ID NO: 4268 - DNA, 17 bp, Artificial sequence
  Synthesized sequence
acggtccgcatcctgct

SEQ ID NO: 4269 - DNA, 17 bp, Artificial sequence
  Synthesized sequence
acggctggtccgttgcg

SEQ ID NO: 4270 - DNA, 17 bp, Artificial sequence
  Synthesized sequence
gtggtggccgggttgca

SEQ ID NO: 4271 - DNA, 17 bp, Artificial sequence
  Synthesized sequence
gaggcggggcaggtgct

SEQ ID NO: 4272 - DNA, 17 bp, Artificial sequence
  Synthesized sequence
atggcatgtctcccgat

SEQ ID NO: 4273 - DNA, 17 bp, Artificial sequence
  Synthesized sequence
atcgcccgtcccttcct

SEQ ID NO: 4274 - DNA, 17 bp, Artificial sequence
  Synthesized sequence
gtgggcccattgtggct

SEQ ID NO: 4275 - DNA, 17 bp, Artificial sequence
  Synthesized sequence
caggcatgctgtttgac

SEQ ID NO: 4276 - DNA, 17 bp, Artificial sequence
  Synthesized sequence
ctggtaagctggtggcc

SEQ ID NO: 4277 - DNA, 17 bp, Artificial sequence
  Synthesized sequence
ctggcaggacgactggc

SEQ ID NO: 4278 - DNA, 17 bp, Artificial sequence
  Synthesized sequence
ctggcaggacgactggc

SEQ ID NO: 4279 - DNA, 17 bp, Artificial sequence
  Synthesized sequence
ctggccggcagcttccc

SEQ ID NO: 4280 - DNA, 17 bp, Artificial sequence
  Synthesized sequence
ttggaaccaaacatgaa

SEQ ID NO: 4281 - DNA, 17 bp, Artificial sequence
  Synthesized sequence
tcggcaggctgctcgcc

SEQ ID NO: 4282 - DNA, 17 bp, Artificial sequence
  Synthesized sequence
ctggctcgtcaccggcg

SEQ ID NO: 4283 - DNA, 17 bp, Artificial sequence
  Synthesized sequence
gcggaacagggatcgca

SEQ ID NO: 4284 - DNA, 17 bp, Artificial sequence
  Synthesized sequence
ctggcgctgccgctggt

SEQ ID NO: 4285 - DNA, 17 bp, Artificial sequence
  Synthesized sequence
gtggcaagcgggtttga

SEQ ID NO: 4286 - DNA, 17 bp, Artificial sequence
  Synthesized sequence
ctggcgcgacctgcgcc

SEQ ID NO: 4287 - DNA, 17 bp, Artificial sequence
  Synthesized sequence
ctcgccctgctggtgca

SEQ ID NO: 4288 - DNA, 17 bp, Artificial sequence
  Synthesized sequence
ctgaatcacagcttgct

SEQ ID NO: 4289 - DNA, 17 bp, Artificial sequence
  Synthesized sequence
ctggaactggcccggct

SEQ ID NO: 4290 - DNA, 17 bp, Artificial sequence
  Synthesized sequence
caggcccgcggcctgcg

SEQ ID NO: 4291 - DNA, 17 bp, Artificial sequence
  Synthesized sequence
gtggctctcgccttccc

SEQ ID NO: 4292 - DNA, 17 bp, Artificial sequence
  Synthesized sequence
gcgggacgttcgtggca

SEQ ID NO: 4293 - DNA, 17 bp, Artificial sequence
  Synthesized sequence
caggactggtggttgct

SEQ ID NO: 4294 - DNA, 17 bp, Artificial sequence
  Synthesized sequence
agggcacgcttcacgcg

SEQ ID NO: 4295 - DNA, 17 bp, Artificial sequence
  Synthesized sequence
atgggctcgctgctgct

SEQ ID NO: 4296 - DNA, 17 bp, Artificial sequence
  Synthesized sequence
ctggtacggggtcggcc

SEQ ID NO: 4297 - DNA, 17 bp, Artificial sequence
  Synthesized sequence
ccggcgcggccttggcc

SEQ ID NO: 4298 - DNA, 17 bp, Artificial sequence
  Synthesized sequence
gcggctggctgcttgcc

SEQ ID NO: 4299 - DNA, 17 bp, Artificial sequence
  Synthesized sequence
ctggccagcctggggct

SEQ ID NO: 4300 - DNA, 17 bp, Artificial sequence
  Synthesized sequence
ctggctcatccactgat

SEQ ID NO: 4301 - DNA, 17 bp, Artificial sequence
  Synthesized sequence
gtggcattcggctccct

SEQ ID NO: 4302 - DNA, 17 bp, Artificial sequence
  Synthesized sequence
gtggcgctgccgcagct

SEQ ID NO: 4303 - DNA, 17 bp, Artificial sequence
  Synthesized sequence
gaggaccggctcctgca

SEQ ID NO: 4304 - DNA, 17 bp, Artificial sequence
  Synthesized sequence
ctggcgcgcctgctggc

SEQ ID NO: 4305 - DNA, 17 bp, Artificial sequence
  Synthesized sequence
ctggcgctgccggtggt

SEQ ID NO: 4306 - DNA, 17 bp, Artificial sequence
  Synthesized sequence
ctcgcacggctggagcg

SEQ ID NO: 4307 - DNA, 17 bp, Artificial sequence
  Synthesized sequence
ctggtctacgtcctgca

SEQ ID NO: 4308 - DNA, 17 bp, Artificial sequence
  Synthesized sequence
ctggtctacgtcctgca

SEQ ID NO: 4309 - DNA, 17 bp, Artificial sequence
  Synthesized sequence
atggcctgcgacgcgct

SEQ ID NO: 4310 - DNA, 17 bp, Artificial sequence
  Synthesized sequence
ctggcccgtgtcgcgcg

SEQ ID NO: 4311 - DNA, 17 bp, Artificial sequence
  Synthesized sequence
ctggaacgggccctggc

SEQ ID NO: 4312 - DNA, 17 bp, Artificial sequence
  Synthesized sequence
ctggcggggggcttccc

SEQ ID NO: 4313 - DNA, 17 bp, Artificial sequence
  Synthesized sequence
atggcggtctggtcgct

SEQ ID NO: 4314 - DNA, 17 bp, Artificial sequence
  Synthesized sequence
atcgaacggccggtgcg

SEQ ID NO: 4315 - DNA, 17 bp, Artificial sequence
  Synthesized sequence
ctggcacacttgcgcct

SEQ ID NO: 4316 - DNA, 17 bp, Artificial sequence
  Synthesized sequence
ctcctacgggggttgct

SEQ ID NO: 4317 - DNA, 17 bp, Artificial sequence
  Synthesized sequence
ctgaaacgattcatgcg

SEQ ID NO: 4318 - DNA, 17 bp, Artificial sequence
  Synthesized sequence
ctcgaagcccagttgct

SEQ ID NO: 4319 - DNA, 17 bp, Artificial sequence
  Synthesized sequence
gtggcagaggtagtggg

SEQ ID NO: 4320 - DNA, 17 bp, Artificial sequence
  Synthesized sequence
gcggcaaggcttcggca

SEQ ID NO: 4321 - DNA, 17 bp, Artificial sequence
  Synthesized sequence
ctggcacggcacgcccc

SEQ ID NO: 4322 - DNA, 17 bp, Artificial sequence
  Synthesized sequence
atggcgagtttcttccc

SEQ ID NO: 4323 - DNA, 17 bp, Artificial sequence
  Synthesized sequence
gtcgcgccggggttgcc

SEQ ID NO: 4324 - DNA, 17 bp, Artificial sequence
  Synthesized sequence
ttggcctggggcccgca

SEQ ID NO: 4325 - DNA, 17 bp, Artificial sequence
  Synthesized sequence
atggttcgccggtcgcg

SEQ ID NO: 4326 - DNA, 17 bp, Artificial sequence
  Synthesized sequence
atgtcatgcggcatgcc

SEQ ID NO: 4327 - DNA, 17 bp, Artificial sequence
  Synthesized sequence
ctggaacagcgcttcaa

SEQ ID NO: 4328 - DNA, 17 bp, Artificial sequence
  Synthesized sequence
tccgtactgctgttgct

SEQ ID NO: 4329 - DNA, 17 bp, Artificial sequence
  Synthesized sequence
ctggccagtcgatggcg

SEQ ID NO: 4330 - DNA, 17 bp, Artificial sequence
  Synthesized sequence
ctggcgccgctctggga

SEQ ID NO: 4331 - DNA, 17 bp, Artificial sequence
  Synthesized sequence
ctggagcagcccgtgcc

SEQ ID NO: 4332 - DNA, 17 bp, Artificial sequence
  Synthesized sequence
cagggatgtcacctgca

SEQ ID NO: 4333 - DNA, 17 bp, Artificial sequence
  Synthesized sequence
ctggtatggaggatggt

SEQ ID NO: 4334 - DNA, 17 bp, Artificial sequence
  Synthesized sequence
ctggtatggaggatggt

SEQ ID NO: 4335 - DNA, 17 bp, Artificial sequence
  Synthesized sequence
ttcgcccacggcgtgct

SEQ ID NO: 4336 - DNA, 17 bp, Artificial sequence
  Synthesized sequence
caggcgcagcagttcca

SEQ ID NO: 4337 - DNA, 17 bp, Artificial sequence
  Synthesized sequence
ctggccctgaacaagca

SEQ ID NO: 4338 - DNA, 17 bp, Artificial sequence
  Synthesized sequence
atggcgtgattggtgtt

SEQ ID NO: 4339 - DNA, 17 bp, Artificial sequence
  Synthesized sequence
ttcgctcagggcatgct

SEQ ID NO: 4340 - DNA, 17 bp, Artificial sequence
  Synthesized sequence
gtgtgacggtacctgcg

SEQ ID NO: 4341 - DNA, 17 bp, Artificial sequence
  Synthesized sequence
aaggcgtcggtcttgcc

SEQ ID NO: 4342 - DNA, 17 bp, Artificial sequence
  Synthesized sequence
caggcgcagggcttgaa

SEQ ID NO: 4343 - DNA, 17 bp, Artificial sequence
  Synthesized sequence
gaggcacgatacccgcc

SEQ ID NO: 4344 - DNA, 17 bp, Artificial sequence
  Synthesized sequence
ttggccccggagccgct

SEQ ID NO: 4345 - DNA, 17 bp, Artificial sequence
  Synthesized sequence
caggcgcaactgctgcc

SEQ ID NO: 4346 - DNA, 17 bp, Artificial sequence
  Synthesized sequence
ctggctcgacgaacgcg

SEQ ID NO: 4347 - DNA, 17 bp, Artificial sequence
  Synthesized sequence
ttggcatcgaacaggcc

SEQ ID NO: 4348 - DNA, 17 bp, Artificial sequence
  Synthesized sequence
cttgcatgaatatttcc

SEQ ID NO: 4349 - DNA, 17 bp, Artificial sequence
  Synthesized sequence
gcggcaagccgatggcg

SEQ ID NO: 4350 - DNA, 17 bp, Artificial sequence
  Synthesized sequence
gcggcaagccgatggcg

SEQ ID NO: 4351 - DNA, 17 bp, Artificial sequence
  Synthesized sequence
gcggcaagccgatggcg

SEQ ID NO: 4352 - DNA, 17 bp, Artificial sequence
  Synthesized sequence
atgggctgggcgctgca

SEQ ID NO: 4353 - DNA, 17 bp, Artificial sequence
  Synthesized sequence
ctggcgcgcctgctggc

SEQ ID NO: 4354 - DNA, 17 bp, Artificial sequence
  Synthesized sequence
gtgacccacgagctgct

SEQ ID NO: 4355 - DNA, 17 bp, Artificial sequence
  Synthesized sequence
caggcgctgccctggct

SEQ ID NO: 4356 - DNA, 17 bp, Artificial sequence
  Synthesized sequence
ctggaagggttccttct

SEQ ID NO: 4357 - DNA, 17 bp, Artificial sequence
  Synthesized sequence
agggcacgacgcaggcg

SEQ ID NO: 4358 - DNA, 17 bp, Artificial sequence
  Synthesized sequence
gccgcgcacctgttgca

SEQ ID NO: 4359 - DNA, 17 bp, Artificial sequence
  Synthesized sequence
ctggtccgcgcctggcg

SEQ ID NO: 4360 - DNA, 17 bp, Artificial sequence
  Synthesized sequence
ttggcggacgatctgcg

SEQ ID NO: 4361 - DNA, 17 bp, Artificial sequence
  Synthesized sequence
gtgctccggccattgcg

SEQ ID NO: 4362 - DNA, 17 bp, Artificial sequence
  Synthesized sequence
cggggtcggccattgcg

SEQ ID NO: 4363 - DNA, 17 bp, Artificial sequence
  Synthesized sequence
tcggcgcggggcgtgcc

SEQ ID NO: 4364 - DNA, 17 bp, Artificial sequence
  Synthesized sequence
tcggcctgagtctttct

SEQ ID NO: 4365 - DNA, 17 bp, Artificial sequence
  Synthesized sequence
ttgatccgcctgttgcc

SEQ ID NO: 4366 - DNA, 17 bp, Artificial sequence
  Synthesized sequence
ctgcccagcaccttgcc

SEQ ID NO: 4367 - DNA, 17 bp, Artificial sequence
  Synthesized sequence
cgggcgcggctattacc

SEQ ID NO: 4368 - DNA, 17 bp, Artificial sequence
  Synthesized sequence
tcggcctggctcatgcg

SEQ ID NO: 4369 - DNA, 17 bp, Artificial sequence
  Synthesized sequence
ctggccagcctggcgct

SEQ ID NO: 4370 - DNA, 17 bp, Artificial sequence
  Synthesized sequence
ctggccagcctggcgct

SEQ ID NO: 4371 - DNA, 17 bp, Artificial sequence
  Synthesized sequence
ctgggcctcggcctgct

SEQ ID NO: 4372 - DNA, 17 bp, Artificial sequence
  Synthesized sequence
ctgggcctcggcctgct

SEQ ID NO: 4373 - DNA, 17 bp, Artificial sequence
  Synthesized sequence
ctggcactggccttctc

SEQ ID NO: 4374 - DNA, 17 bp, Artificial sequence
  Synthesized sequence
gaggtatgcgccatgca

SEQ ID NO: 4375 - DNA, 17 bp, Artificial sequence
  Synthesized sequence
gtggccggaggctttcc

SEQ ID NO: 4376 - DNA, 17 bp, Artificial sequence
  Synthesized sequence
ctgccctgggacatgct

SEQ ID NO: 4377 - DNA, 17 bp, Artificial sequence
  Synthesized sequence
gcggcgtgctgcctgct

SEQ ID NO: 4378 - DNA, 17 bp, Artificial sequence
  Synthesized sequence
ctggcgcggcaactggc

SEQ ID NO: 4379 - DNA, 17 bp, Artificial sequence
  Synthesized sequence
cgggcaagcccgtcgcc

SEQ ID NO: 4380 - DNA, 17 bp, Artificial sequence
  Synthesized sequence
cgggcaagcccgtcgcc

SEQ ID NO: 4381 - DNA, 17 bp, Artificial sequence
  Synthesized sequence
atggaaaccgccttgtt

SEQ ID NO: 4382 - DNA, 17 bp, Artificial sequence
  Synthesized sequence
gaggcgctgtcgatgct

SEQ ID NO: 4383 - DNA, 17 bp, Artificial sequence
  Synthesized sequence
caggcatcgcccatgcc

SEQ ID NO: 4384 - DNA, 17 bp, Artificial sequence
  Synthesized sequence
atggccgtccggtggca

SEQ ID NO: 4385 - DNA, 17 bp, Artificial sequence
  Synthesized sequence
ttgacgccgatcatgca

SEQ ID NO: 4386 - DNA, 17 bp, Artificial sequence
  Synthesized sequence
caggcgctggagctgct

SEQ ID NO: 4387 - DNA, 17 bp, Artificial sequence
  Synthesized sequence
cgggcacggcccgtccg

SEQ ID NO: 4388 - DNA, 17 bp, Artificial sequence
  Synthesized sequence
cgggcacggcccgtccg

SEQ ID NO: 4389 - DNA, 17 bp, Artificial sequence
  Synthesized sequence
ttgggtcaggcattgtt

SEQ ID NO: 4390 - DNA, 17 bp, Artificial sequence
  Synthesized sequence
gtgacaaaaatttttca

SEQ ID NO: 4391 - DNA, 17 bp, Artificial sequence
  Synthesized sequence
atgggtcggcaatggcg

SEQ ID NO: 4392 - DNA, 17 bp, Artificial sequence
  Synthesized sequence
tacgcactgctcctgca

SEQ ID NO: 4393 - DNA, 17 bp, Artificial sequence
  Synthesized sequence
gcgccgcgtcccttgca

SEQ ID NO: 4394 - DNA, 17 bp, Artificial sequence
  Synthesized sequence
ccggcaagccggtggcc

SEQ ID NO: 4395 - DNA, 17 bp, Artificial sequence
  Synthesized sequence
ccggcgctggccatgct

SEQ ID NO: 4396 - DNA, 17 bp, Artificial sequence
  Synthesized sequence
ttcgggccgctgttgca

SEQ ID NO: 4397 - DNA, 17 bp, Artificial sequence
  Synthesized sequence
aaggcccgccgctggcg

SEQ ID NO: 4398 - DNA, 17 bp, Artificial sequence
  Synthesized sequence
ctggcccagcgcttcgt

SEQ ID NO: 4399 - DNA, 17 bp, Artificial sequence
  Synthesized sequence
ctgcgccaggccttgca

SEQ ID NO: 4400 - DNA, 17 bp, Artificial sequence
  Synthesized sequence
ctgccgctagaattgcg

SEQ ID NO: 4401 - DNA, 17 bp, Artificial sequence
  Synthesized sequence
ttggcgagcggttcgcc

SEQ ID NO: 4402 - DNA, 17 bp, Artificial sequence
  Synthesized sequence
gtggctcgcctgctacc

SEQ ID NO: 4403 - DNA, 17 bp, Artificial sequence
  Synthesized sequence
gtggcggcgatgctgcg

SEQ ID NO: 4404 - DNA, 17 bp, Artificial sequence
  Synthesized sequence
ctggcgcagtcatcggt

SEQ ID NO: 4405 - DNA, 17 bp, Artificial sequence
  Synthesized sequence
atggtttgccaattgtt

SEQ ID NO: 4406 - DNA, 17 bp, Artificial sequence
  Synthesized sequence
caggcgctgctgtttct

SEQ ID NO: 4407 - DNA, 17 bp, Artificial sequence
  Synthesized sequence
gccgaacgttccttgct

SEQ ID NO: 4408 - DNA, 17 bp, Artificial sequence
  Synthesized sequence
gccgaacgttccttgct

SEQ ID NO: 4409 - DNA, 17 bp, Artificial sequence
  Synthesized sequence
acggcaagccgctggcc

SEQ ID NO: 4410 - DNA, 17 bp, Artificial sequence
  Synthesized sequence
gttgcacaatccgcgct

SEQ ID NO: 4411 - DNA, 17 bp, Artificial sequence
  Synthesized sequence
ttggacgggcattggct

SEQ ID NO: 4412 - DNA, 17 bp, Artificial sequence
  Synthesized sequence
ttggcgtgaatttcgat

SEQ ID NO: 4413 - DNA, 17 bp, Artificial sequence
  Synthesized sequence
tcgggcctgggcttgct

SEQ ID NO: 4414 - DNA, 17 bp, Artificial sequence
  Synthesized sequence
cgggcgcggcactttcc

SEQ ID NO: 4415 - DNA, 17 bp, Artificial sequence
  Synthesized sequence
cctggacagagcttgct

SEQ ID NO: 4416 - DNA, 17 bp, Artificial sequence
  Synthesized sequence
gtggattcggccttgcg

SEQ ID NO: 4417 - DNA, 17 bp, Artificial sequence
  Synthesized sequence
atggctgtagccttggt

SEQ ID NO: 4418 - DNA, 17 bp, Artificial sequence
  Synthesized sequence
attgcccgcacattgaa

SEQ ID NO: 4419 - DNA, 17 bp, Artificial sequence
  Synthesized sequence
gtggcaagaccggtacc

SEQ ID NO: 4420 - DNA, 17 bp, Artificial sequence
  Synthesized sequence
ctggcgctgcggccgct

SEQ ID NO: 4421 - DNA, 17 bp, Artificial sequence
  Synthesized sequence
tcggctaatacgttgca

SEQ ID NO: 4422 - DNA, 17 bp, Artificial sequence
  Synthesized sequence
atggatggccgcctgct

SEQ ID NO: 4423 - DNA, 17 bp, Artificial sequence
  Synthesized sequence
atggcaaaccaatgaca

SEQ ID NO: 4424 - DNA, 17 bp, Artificial sequence
  Synthesized sequence
ccggcttcgcccttgcc

SEQ ID NO: 4425 - DNA, 17 bp, Artificial sequence
  Synthesized sequence
ccggcgcaggaatggct

SEQ ID NO: 4426 - DNA, 17 bp, Artificial sequence
  Synthesized sequence
ctggctgggggttcgcc

SEQ ID NO: 4427 - DNA, 17 bp, Artificial sequence
  Synthesized sequence
ctggaacgtctgcagcg

SEQ ID NO: 4428 - DNA, 17 bp, Artificial sequence
  Synthesized sequence
ctggcgcgggtctgccg

SEQ ID NO: 4429 - DNA, 17 bp, Artificial sequence
  Synthesized sequence
ctggcagccaactcgat

SEQ ID NO: 4430 - DNA, 17 bp, Artificial sequence
  Synthesized sequence
caggtaaccgcgttgct

SEQ ID NO: 4431 - DNA, 17 bp, Artificial sequence
  Synthesized sequence
atggcgagataattccc

SEQ ID NO: 4432 - DNA, 17 bp, Artificial sequence
  Synthesized sequence
atggcgagataattccc

SEQ ID NO: 4433 - DNA, 17 bp, Artificial sequence
  Synthesized sequence
gtgccagacgcctcgct

SEQ ID NO: 4434 - DNA, 17 bp, Artificial sequence
  Synthesized sequence
gtggcctgaccctggat

SEQ ID NO: 4435 - DNA, 17 bp, Artificial sequence
  Synthesized sequence
ggggccctcgttctgca

SEQ ID NO: 4436 - DNA, 17 bp, Artificial sequence
  Synthesized sequence
ctagcaccctctatgcc

SEQ ID NO: 4437 - DNA, 17 bp, Artificial sequence
  Synthesized sequence
gtggcgccgaaggcgct

SEQ ID NO: 4438 - DNA, 17 bp, Artificial sequence
  Synthesized sequence
ctggtgggcaccgtgct

SEQ ID NO: 4439 - DNA, 17 bp, Artificial sequence
  Synthesized sequence
gaggctctgaagctgct

SEQ ID NO: 4440 - DNA, 17 bp, Artificial sequence
  Synthesized sequence
ctggcgcaggcagtgaa

SEQ ID NO: 4441 - DNA, 17 bp, Artificial sequence
  Synthesized sequence
atggcgaggctactgga

SEQ ID NO: 4442 - DNA, 17 bp, Artificial sequence
  Synthesized sequence
gtcgatcagccgttgca

SEQ ID NO: 4443 - DNA, 17 bp, Artificial sequence
  Synthesized sequence
gcggcacggccggggcg

SEQ ID NO: 4444 - DNA, 17 bp, Artificial sequence
  Synthesized sequence
ctggtgggcgtgatgct

SEQ ID NO: 4445 - DNA, 17 bp, Artificial sequence
  Synthesized sequence
ctgggtcttctgctgca

SEQ ID NO: 4446 - DNA, 17 bp, Artificial sequence
  Synthesized sequence
gtcgcgcaggccctgca

SEQ ID NO: 4447 - DNA, 17 bp, Artificial sequence
  Synthesized sequence
tcgggaaaacgcttgcc

SEQ ID NO: 4448 - DNA, 17 bp, Artificial sequence
  Synthesized sequence
ctggtcctggcctggca

SEQ ID NO: 4449 - DNA, 17 bp, Artificial sequence
  Synthesized sequence
ctggccgggctggtcct

SEQ ID NO: 4450 - DNA, 17 bp, Artificial sequence
  Synthesized sequence
ctgggcctcgccctgca

SEQ ID NO: 4451 - DNA, 17 bp, Artificial sequence
  Synthesized sequence
attgaaatccctttgct

SEQ ID NO: 4452 - DNA, 17 bp, Artificial sequence
  Synthesized sequence
gtgctgcgcctgttgcc

SEQ ID NO: 4453 - DNA, 17 bp, Artificial sequence
  Synthesized sequence
ttggcaagctggccgcc

SEQ ID NO: 4454 - DNA, 17 bp, Artificial sequence
  Synthesized sequence
ctggccttccaggtgcc

SEQ ID NO: 4455 - DNA, 17 bp, Artificial sequence
  Synthesized sequence
ctggctcgccaccggcc

SEQ ID NO: 4456 - DNA, 17 bp, Artificial sequence
  Synthesized sequence
ccggcgcgatgcgtgcc

SEQ ID NO: 4457 - DNA, 17 bp, Artificial sequence
  Synthesized sequence
gaggccctgacctggct

SEQ ID NO: 4458 - DNA, 17 bp, Artificial sequence
  Synthesized sequence
ctggcccggaagatccg

SEQ ID NO: 4459 - DNA, 17 bp, Artificial sequence
  Synthesized sequence
gtggcgcaccgttcggt

SEQ ID NO: 4460 - DNA, 17 bp, Artificial sequence
  Synthesized sequence
gtggcgcggtagcggcg

SEQ ID NO: 4461 - DNA, 17 bp, Artificial sequence
  Synthesized sequence
gagccagcgcaattgct

SEQ ID NO: 4462 - DNA, 17 bp, Artificial sequence
  Synthesized sequence
gtggcgctcctggagca

SEQ ID NO: 4463 - DNA, 17 bp, Artificial sequence
  Synthesized sequence
ctggagccgctgctgcg

SEQ ID NO: 4464 - DNA, 17 bp, Artificial sequence
  Synthesized sequence
atcgcccgccagttcca

SEQ ID NO: 4465 - DNA, 17 bp, Artificial sequence
  Synthesized sequence
ccggccagccgcctgct

SEQ ID NO: 4466 - DNA, 17 bp, Artificial sequence
  Synthesized sequence
acggcacacggcaagct

SEQ ID NO: 4467 - DNA, 17 bp, Artificial sequence
  Synthesized sequence
ccggcccatcgctggct

SEQ ID NO: 4468 - DNA, 17 bp, Artificial sequence
  Synthesized sequence
cgcgcagggaagttgcg

SEQ ID NO: 4469 - DNA, 17 bp, Artificial sequence
  Synthesized sequence
aaggcccagccattgga

SEQ ID NO: 4470 - DNA, 17 bp, Artificial sequence
  Synthesized sequence
tcggcgcgatcgatgcg

SEQ ID NO: 4471 - DNA, 17 bp, Artificial sequence
  Synthesized sequence
caggcacagggcgagca

SEQ ID NO: 4472 - DNA, 17 bp, Artificial sequence
  Synthesized sequence
ctggtctaccgcctgct

SEQ ID NO: 4473 - DNA, 17 bp, Artificial sequence
  Synthesized sequence
ccggcgcggtattcgcg

SEQ ID NO: 4474 - DNA, 17 bp, Artificial sequence
  Synthesized sequence
aaggcgttgcgcttgcc

SEQ ID NO: 4475 - DNA, 17 bp, Artificial sequence
  Synthesized sequence
ctggcgcagaaatgggt

SEQ ID NO: 4476 - DNA, 17 bp, Artificial sequence
  Synthesized sequence
ccggcgccccgtatgct

SEQ ID NO: 4477 - DNA, 17 bp, Artificial sequence
  Synthesized sequence
ctggcaggggcgtcgag

SEQ ID NO: 4478 - DNA, 17 bp, Artificial sequence
  Synthesized sequence
ctggcgctggaaccgct

SEQ ID NO: 4479 - DNA, 17 bp, Artificial sequence
  Synthesized sequence
atcgctcgcggggtgca

SEQ ID NO: 4480 - DNA, 17 bp, Artificial sequence
  Synthesized sequence
ctggcgttcttctcgcc

SEQ ID NO: 4481 - DNA, 17 bp, Artificial sequence
  Synthesized sequence
gcggcgcggcgctggcg

SEQ ID NO: 4482 - DNA, 17 bp, Artificial sequence
  Synthesized sequence
ctggaaaacgatctgcg

SEQ ID NO: 4483 - DNA, 17 bp, Artificial sequence
  Synthesized sequence
ctggcacgaatgccggg

SEQ ID NO: 4484 - DNA, 17 bp, Artificial sequence
  Synthesized sequence
ctggcctataactcgcg

SEQ ID NO: 4485 - DNA, 17 bp, Artificial sequence
  Synthesized sequence
ctgctgcggcatttgcg

SEQ ID NO: 4486 - DNA, 17 bp, Artificial sequence
  Synthesized sequence
acggcagggtcgtcgcc

SEQ ID NO: 4487 - DNA, 17 bp, Artificial sequence
  Synthesized sequence
tcggcaagcgcggtgcc

SEQ ID NO: 4488 - DNA, 17 bp, Artificial sequence
  Synthesized sequence
ctggcgccgcgaacgca

SEQ ID NO: 4489 - DNA, 17 bp, Artificial sequence
  Synthesized sequence
tcggccagcgggttgcc

SEQ ID NO: 4490 - DNA, 17 bp, Artificial sequence
  Synthesized sequence
tcggccagcgggttgcc

SEQ ID NO: 4491 - DNA, 17 bp, Artificial sequence
  Synthesized sequence
ctggcccgccatgggcc

SEQ ID NO: 4492 - DNA, 17 bp, Artificial sequence
  Synthesized sequence
tcggcgcggccatcgcc

SEQ ID NO: 4493 - DNA, 17 bp, Artificial sequence
  Synthesized sequence
gtggaggtgctgttgcc

SEQ ID NO: 4494 - DNA, 17 bp, Artificial sequence
  Synthesized sequence
taggaacagttgctgcg

SEQ ID NO: 4495 - DNA, 17 bp, Artificial sequence
  Synthesized sequence
ctggcatatctggtggc

SEQ ID NO: 4496 - DNA, 17 bp, Artificial sequence
  Synthesized sequence
gtggtcggtctctcgct

SEQ ID NO: 4497 - DNA, 17 bp, Artificial sequence
  Synthesized sequence
acggcaagctggatgcc

SEQ ID NO: 4498 - DNA, 17 bp, Artificial sequence
  Synthesized sequence
atggccgccgcgatgca

SEQ ID NO: 4499 - DNA, 17 bp, Artificial sequence
  Synthesized sequence
aaggccggggtgatgct

SEQ ID NO: 4500 - DNA, 17 bp, Artificial sequence
  Synthesized sequence
ccagcaccccggttgcg

SEQ ID NO: 4501 - DNA, 17 bp, Artificial sequence
  Synthesized sequence
gtgacgcgagtcctgcg

SEQ ID NO: 4502 - DNA, 17 bp, Artificial sequence
  Synthesized sequence
ttgggagttttcttact

SEQ ID NO: 4503 - DNA, 17 bp, Artificial sequence
  Synthesized sequence
atgccacacttcccgca

SEQ ID NO: 4504 - DNA, 17 bp, Artificial sequence
  Synthesized sequence
ccggcaaacgtcatgcc

SEQ ID NO: 4505 - DNA, 17 bp, Artificial sequence
  Synthesized sequence
ttcgagcggcgtttgcg

SEQ ID NO: 4506 - DNA, 17 bp, Artificial sequence
  Synthesized sequence
tcggcaagagcatcgcg

SEQ ID NO: 4507 - DNA, 17 bp, Artificial sequence
  Synthesized sequence
caggcgcgggcgatgcg

SEQ ID NO: 4508 - DNA, 17 bp, Artificial sequence
  Synthesized sequence
acggcacgcggagggca

SEQ ID NO: 4509 - DNA, 17 bp, Artificial sequence
  Synthesized sequence
ctggcactgctgcgcct

SEQ ID NO: 4510 - DNA, 17 bp, Artificial sequence
  Synthesized sequence
ctggcctgccatgagca

SEQ ID NO: 4511 - DNA, 17 bp, Artificial sequence
  Synthesized sequence
ctgccgcggtctttcct

SEQ ID NO: 4512 - DNA, 17 bp, Artificial sequence
  Synthesized sequence
ctggtgagccaggtgct

SEQ ID NO: 4513 - DNA, 17 bp, Artificial sequence
  Synthesized sequence
ctggccctggagcggct

SEQ ID NO: 4514 - DNA, 17 bp, Artificial sequence
  Synthesized sequence
gtggaagaccgggtgcg

SEQ ID NO: 4515 - DNA, 17 bp, Artificial sequence
  Synthesized sequence
acggcaccctgatcgcc

SEQ ID NO: 4516 - DNA, 17 bp, Artificial sequence
  Synthesized sequence
ctgggcccctggctgct

SEQ ID NO: 4517 - DNA, 17 bp, Artificial sequence
  Synthesized sequence
gcggcctacctgctgct

SEQ ID NO: 4518 - DNA, 17 bp, Artificial sequence
  Synthesized sequence
gaggacggcatgttgct

SEQ ID NO: 4519 - DNA, 17 bp, Artificial sequence
  Synthesized sequence
ctggaaggggcgttccg

SEQ ID NO: 4520 - DNA, 17 bp, Artificial sequence
  Synthesized sequence
gtggaaatcctgatgcg

SEQ ID NO: 4521 - DNA, 17 bp, Artificial sequence
  Synthesized sequence
cccgtacgactattgcc

SEQ ID NO: 4522 - DNA, 17 bp, Artificial sequence
  Synthesized sequence
acggcaaggagatcgcc

SEQ ID NO: 4523 - DNA, 17 bp, Artificial sequence
  Synthesized sequence
ctggggcacctggtgcc

SEQ ID NO: 4524 - DNA, 17 bp, Artificial sequence
  Synthesized sequence
gcgggatacctgctgct

SEQ ID NO: 4525 - DNA, 17 bp, Artificial sequence
  Synthesized sequence
ctgccgcgcgactggca

SEQ ID NO: 4526 - DNA, 17 bp, Artificial sequence
  Synthesized sequence
cggccacgccggtcgct

SEQ ID NO: 4527 - DNA, 17 bp, Artificial sequence
  Synthesized sequence
ctttcaccgcgcttgcg

SEQ ID NO: 4528 - DNA, 17 bp, Artificial sequence
  Synthesized sequence
gtgatacgcatgctgcg

SEQ ID NO: 4529 - DNA, 17 bp, Artificial sequence
  Synthesized sequence
gaggcgcggacggtgcg

SEQ ID NO: 4530 - DNA, 17 bp, Artificial sequence
  Synthesized sequence
ctggaatgttgctttcg

SEQ ID NO: 4531 - DNA, 17 bp, Artificial sequence
  Synthesized sequence
acggcgccgaagatgct

SEQ ID NO: 4532 - DNA, 17 bp, Artificial sequence
  Synthesized sequence
ctgggctgatcctcgct

SEQ ID NO: 4533 - DNA, 17 bp, Artificial sequence
  Synthesized sequence
ctggcccacgagctgaa

SEQ ID NO: 4534 - DNA, 17 bp, Artificial sequence
  Synthesized sequence
gtcgcacagttaccgca

SEQ ID NO: 4535 - DNA, 17 bp, Artificial sequence
  Synthesized sequence
ccggcccggacctggcc

SEQ ID NO: 4536 - DNA, 17 bp, Artificial sequence
  Synthesized sequence
ccggcccggacctggcc

SEQ ID NO: 4537 - DNA, 17 bp, Artificial sequence
  Synthesized sequence
ctggaactggagccgct

SEQ ID NO: 4538 - DNA, 17 bp, Artificial sequence
  Synthesized sequence
atgggactgaccctgta

SEQ ID NO: 4539 - DNA, 17 bp, Artificial sequence
  Synthesized sequence
acggaaaaggccttgcg

SEQ ID NO: 4540 - DNA, 17 bp, Artificial sequence
  Synthesized sequence
ggggaacacgccttgtt

SEQ ID NO: 4541 - DNA, 17 bp, Artificial sequence
  Synthesized sequence
cgggcaatgaattcgca

SEQ ID NO: 4542 - DNA, 17 bp, Artificial sequence
  Synthesized sequence
gcggcacgacatccgcc

SEQ ID NO: 4543 - DNA, 17 bp, Artificial sequence
  Synthesized sequence
accgcacggctgctgcc

SEQ ID NO: 4544 - DNA, 17 bp, Artificial sequence
  Synthesized sequence
tttacaggtcgtttgct

SEQ ID NO: 4545 - DNA, 17 bp, Artificial sequence
  Synthesized sequence
tgggctacctcattgct

SEQ ID NO: 4546 - DNA, 17 bp, Artificial sequence
  Synthesized sequence
caggcgcgccgactgcc

SEQ ID NO: 4547 - DNA, 17 bp, Artificial sequence
  Synthesized sequence
ttggcccccctctccct

SEQ ID NO: 4548 - DNA, 17 bp, Artificial sequence
  Synthesized sequence
ctggccgggttgccgct

SEQ ID NO: 4549 - DNA, 17 bp, Artificial sequence
  Synthesized sequence
atggcaaccggcgtgat

SEQ ID NO: 4550 - DNA, 17 bp, Artificial sequence
  Synthesized sequence
ctggcgcaacgactaca

SEQ ID NO: 4551 - DNA, 17 bp, Artificial sequence
  Synthesized sequence
ctggggctctgcgtgct

SEQ ID NO: 4552 - DNA, 17 bp, Artificial sequence
  Synthesized sequence
ctggctcggcgtcggcg

SEQ ID NO: 4553 - DNA, 17 bp, Artificial sequence
  Synthesized sequence
gtggccaacgacctgcc

SEQ ID NO: 4554 - DNA, 17 bp, Artificial sequence
  Synthesized sequence
atggcctggtgcaggca

SEQ ID NO: 4555 - DNA, 17 bp, Artificial sequence
  Synthesized sequence
agggcgacctgtttgct

SEQ ID NO: 4556 - DNA, 17 bp, Artificial sequence
  Synthesized sequence
agggcgacctgtttgct

SEQ ID NO: 4557 - DNA, 17 bp, Artificial sequence
  Synthesized sequence
atggcgagcgcatcgcg

SEQ ID NO: 4558 - DNA, 17 bp, Artificial sequence
  Synthesized sequence
atggttccgcagtggca

SEQ ID NO: 4559 - DNA, 17 bp, Artificial sequence
  Synthesized sequence
ctggaactgccagggct

SEQ ID NO: 4560 - DNA, 17 bp, Artificial sequence
  Synthesized sequence
tttgctcatctgctgct

SEQ ID NO: 4561 - DNA, 17 bp, Artificial sequence
  Synthesized sequence
atgtcctgttgcttgcc

SEQ ID NO: 4562 - DNA, 17 bp, Artificial sequence
  Synthesized sequence
ctggcccattacctgaa

SEQ ID NO: 4563 - DNA, 17 bp, Artificial sequence
  Synthesized sequence
cggcctcgccggttgca

SEQ ID NO: 4564 - DNA, 17 bp, Artificial sequence
  Synthesized sequence
agggcgctggccatgct

SEQ ID NO: 4565 - DNA, 17 bp, Artificial sequence
  Synthesized sequence
atggcccagctggagcg

SEQ ID NO: 4566 - DNA, 17 bp, Artificial sequence
  Synthesized sequence
gtggcgctggtcgtgga

SEQ ID NO: 4567 - DNA, 17 bp, Artificial sequence
  Synthesized sequence
gccgcgcggcccttgcg

SEQ ID NO: 4568 - DNA, 17 bp, Artificial sequence
  Synthesized sequence
ctggcaggcgcagggcg

SEQ ID NO: 4569 - DNA, 17 bp, Artificial sequence
  Synthesized sequence
ttgccgtaggtgttgcc

SEQ ID NO: 4570 - DNA, 17 bp, Artificial sequence
  Synthesized sequence
tttgcccagacgctgca

SEQ ID NO: 4571 - DNA, 17 bp, Artificial sequence
  Synthesized sequence
gaggaagtcgagttgct

SEQ ID NO: 4572 - DNA, 17 bp, Artificial sequence
  Synthesized sequence
gtcgcgcgaggctttct

SEQ ID NO: 4573 - DNA, 17 bp, Artificial sequence
  Synthesized sequence
gtcgaccaggcgttgct

SEQ ID NO: 4574 - DNA, 17 bp, Artificial sequence
  Synthesized sequence
ccggcagatccatttct

SEQ ID NO: 4575 - DNA, 17 bp, Artificial sequence
  Synthesized sequence
ttgcaccaggccttgca

SEQ ID NO: 4576 - DNA, 17 bp, Artificial sequence
  Synthesized sequence
ttgcaccaggccttgca

SEQ ID NO: 4577 - DNA, 17 bp, Artificial sequence
  Synthesized sequence
ctggcgagcgcatggcg

SEQ ID NO: 4578 - DNA, 17 bp, Artificial sequence
  Synthesized sequence
ctggcgagcgcatggcg

SEQ ID NO: 4579 - DNA, 17 bp, Artificial sequence
  Synthesized sequence
gtgacaaaagcgatgca

SEQ ID NO: 4580 - DNA, 17 bp, Artificial sequence
  Synthesized sequence
gtgacaaaagcgatgca

SEQ ID NO: 4581 - DNA, 17 bp, Artificial sequence
  Synthesized sequence
atggcgagcctcctgtt

SEQ ID NO: 4582 - DNA, 17 bp, Artificial sequence
  Synthesized sequence
gaggcattgtacctgcg

SEQ ID NO: 4583 - DNA, 17 bp, Artificial sequence
  Synthesized sequence
atggcgcagatattcaa

SEQ ID NO: 4584 - DNA, 17 bp, Artificial sequence
  Synthesized sequence
ctggcgcaactggcgcg

SEQ ID NO: 4585 - DNA, 17 bp, Artificial sequence
  Synthesized sequence
ctggcgcaactggcgcg

SEQ ID NO: 4586 - DNA, 17 bp, Artificial sequence
  Synthesized sequence
ctgggcggcgacctgct

SEQ ID NO: 4587 - DNA, 17 bp, Artificial sequence
  Synthesized sequence
aaggcccggccgttgag

SEQ ID NO: 4588 - DNA, 17 bp, Artificial sequence
  Synthesized sequence
ccggtgcgcggcttgcg

SEQ ID NO: 4589 - DNA, 17 bp, Artificial sequence
  Synthesized sequence
ttggcacggaacggggg

SEQ ID NO: 4590 - DNA, 17 bp, Artificial sequence
  Synthesized sequence
atggcccgcatgctacc

SEQ ID NO: 4591 - DNA, 17 bp, Artificial sequence
  Synthesized sequence
gtggcgaggatcaggca

SEQ ID NO: 4592 - DNA, 17 bp, Artificial sequence
  Synthesized sequence
tcggcagcaatatagca

SEQ ID NO: 4593 - DNA, 17 bp, Artificial sequence
  Synthesized sequence
gaggcacacgccatgtt

SEQ ID NO: 4594 - DNA, 17 bp, Artificial sequence
  Synthesized sequence
acggcacgaggctggaa

SEQ ID NO: 4595 - DNA, 17 bp, Artificial sequence
  Synthesized sequence
ttggcgctacgaccgct

SEQ ID NO: 4596 - DNA, 17 bp, Artificial sequence
  Synthesized sequence
atggacagggactcgct

SEQ ID NO: 4597 - DNA, 17 bp, Artificial sequence
  Synthesized sequence
ccggcgccgcgctcgca

SEQ ID NO: 4598 - DNA, 17 bp, Artificial sequence
  Synthesized sequence
tgggcggcgctgttgcg

SEQ ID NO: 4599 - DNA, 17 bp, Artificial sequence
  Synthesized sequence
ctggcccgggcagggcg

SEQ ID NO: 4600 - DNA, 17 bp, Artificial sequence
  Synthesized sequence
taggaacgattcttggc

SEQ ID NO: 4601 - DNA, 17 bp, Artificial sequence
  Synthesized sequence
ttgtcagaggcctttct

SEQ ID NO: 4602 - DNA, 17 bp, Artificial sequence
  Synthesized sequence
cttgccccccacatgct

SEQ ID NO: 4603 - DNA, 17 bp, Artificial sequence
  Synthesized sequence
ttggccagggcgttgac

SEQ ID NO: 4604 - DNA, 17 bp, Artificial sequence
  Synthesized sequence
cggacacgaggctggct

SEQ ID NO: 4605 - DNA, 17 bp, Artificial sequence
  Synthesized sequence
gtggagcgctggctgcg

SEQ ID NO: 4606 - DNA, 17 bp, Artificial sequence
  Synthesized sequence
acggcatcatcgtttct

SEQ ID NO: 4607 - DNA, 17 bp, Artificial sequence
  Synthesized sequence
ctggcgcgcgcatggaa

SEQ ID NO: 4608 - DNA, 17 bp, Artificial sequence
  Synthesized sequence
cttgccgatcagttgca

SEQ ID NO: 4609 - DNA, 17 bp, Artificial sequence
  Synthesized sequence
ctgggaccgccagggct

SEQ ID NO: 4610 - DNA, 17 bp, Artificial sequence
  Synthesized sequence
tcggctgaatttttgcc

SEQ ID NO: 4611 - DNA, 17 bp, Artificial sequence
  Synthesized sequence
ctgggcgaaggcttgcg

SEQ ID NO: 4612 - DNA, 17 bp, Artificial sequence
  Synthesized sequence
atcgtccgccgcttgcg

SEQ ID NO: 4613 - DNA, 17 bp, Artificial sequence
  Synthesized sequence
atggaacagcttgcgcc

SEQ ID NO: 4614 - DNA, 17 bp, Artificial sequence
  Synthesized sequence
gaggaacgcgcttttca

SEQ ID NO: 4615 - DNA, 17 bp, Artificial sequence
  Synthesized sequence
caggcagtggcatcgct

SEQ ID NO: 4616 - DNA, 17 bp, Artificial sequence
  Synthesized sequence
gtggtggcgcagttgcc

SEQ ID NO: 4617 - DNA, 17 bp, Artificial sequence
  Synthesized sequence
ctggtcggccgggtgct

SEQ ID NO: 4618 - DNA, 17 bp, Artificial sequence
  Synthesized sequence
ctggccgggatcgtgaa

SEQ ID NO: 4619 - DNA, 17 bp, Artificial sequence
  Synthesized sequence
ctggtcaagcgcctgct

SEQ ID NO: 4620 - DNA, 17 bp, Artificial sequence
  Synthesized sequence
gtcgtgcaaccgttgca

SEQ ID NO: 4621 - DNA, 17 bp, Artificial sequence
  Synthesized sequence
atcggatgcgcattgcc

SEQ ID NO: 4622 - DNA, 17 bp, Artificial sequence
  Synthesized sequence
tcggcatagcgttcgcc

SEQ ID NO: 4623 - DNA, 17 bp, Artificial sequence
  Synthesized sequence
ttgggtccgctattgga

SEQ ID NO: 4624 - DNA, 17 bp, Artificial sequence
  Synthesized sequence
cttgcaggctcgtttca

SEQ ID NO: 4625 - DNA, 17 bp, Artificial sequence
  Synthesized sequence
cgggcacgcctggagcg

SEQ ID NO: 4626 - DNA, 17 bp, Artificial sequence
  Synthesized sequence
tcggcccggcgctggcc

SEQ ID NO: 4627 - DNA, 17 bp, Artificial sequence
  Synthesized sequence
atggcgtggatctatct

SEQ ID NO: 4628 - DNA, 17 bp, Artificial sequence
  Synthesized sequence
ctgttccaccagttgca

SEQ ID NO: 4629 - DNA, 17 bp, Artificial sequence
  Synthesized sequence
atgggccaaggtttgtt

SEQ ID NO: 4630 - DNA, 17 bp, Artificial sequence
  Synthesized sequence
gggttatggctattgca

SEQ ID NO: 4631 - DNA, 17 bp, Artificial sequence
  Synthesized sequence
gtggcacaacgtgcgga

SEQ ID NO: 4632 - DNA, 17 bp, Artificial sequence
  Synthesized sequence
gtggccgccgggctgca

SEQ ID NO: 4633 - DNA, 17 bp, Artificial sequence
  Synthesized sequence
ctggcaggcgctcagcg

SEQ ID NO: 4634 - DNA, 17 bp, Artificial sequence
  Synthesized sequence
acggcgcggccttcgcc

SEQ ID NO: 4635 - DNA, 17 bp, Artificial sequence
  Synthesized sequence
ccggcaccctggtggcc

SEQ ID NO: 4636 - DNA, 17 bp, Artificial sequence
  Synthesized sequence
atggccgaccggatgcc

SEQ ID NO: 4637 - DNA, 17 bp, Artificial sequence
  Synthesized sequence
gcggcatgctgatggcc

SEQ ID NO: 4638 - DNA, 17 bp, Artificial sequence
  Synthesized sequence
agggcgcgctgcctgcg

SEQ ID NO: 4639 - DNA, 17 bp, Artificial sequence
  Synthesized sequence
ctggaagagctgtttcc

SEQ ID NO: 4640 - DNA, 17 bp, Artificial sequence
  Synthesized sequence
ctggcgacgcgcctgcg

SEQ ID NO: 4641 - DNA, 17 bp, Artificial sequence
  Synthesized sequence
acggcacggcgcgggcc

SEQ ID NO: 4642 - DNA, 17 bp, Artificial sequence
  Synthesized sequence
atggggccggcgctgct

SEQ ID NO: 4643 - DNA, 17 bp, Artificial sequence
  Synthesized sequence
gtggcgcgggtggtgtc

SEQ ID NO: 4644 - DNA, 17 bp, Artificial sequence
  Synthesized sequence
gtggattcggccttgcg

SEQ ID NO: 4645 - DNA, 17 bp, Artificial sequence
  Synthesized sequence
ctggccaaccgggtgcg

SEQ ID NO: 4646 - DNA, 17 bp, Artificial sequence
  Synthesized sequence
gtggcgagagccttggc

SEQ ID NO: 4647 - DNA, 17 bp, Artificial sequence
  Synthesized sequence
atggaatgactctgcca

SEQ ID NO: 4648 - DNA, 17 bp, Artificial sequence
  Synthesized sequence
ctggcaccgctgcagat

SEQ ID NO: 4649 - DNA, 17 bp, Artificial sequence
  Synthesized sequence
gtggcgcaatgctggat

SEQ ID NO: 4650 - DNA, 17 bp, Artificial sequence
  Synthesized sequence
gtcgcaagggccgtgcc

SEQ ID NO: 4651 - DNA, 17 bp, Artificial sequence
  Synthesized sequence
gtcgcaagggccgtgcc

SEQ ID NO: 4652 - DNA, 17 bp, Artificial sequence
  Synthesized sequence
ctcgccccggtgatgct

SEQ ID NO: 4653 - DNA, 17 bp, Artificial sequence
  Synthesized sequence
ctggcgccggaccagca

SEQ ID NO: 4654 - DNA, 17 bp, Artificial sequence
  Synthesized sequence
cgggcgccgccgatgca

SEQ ID NO: 4655 - DNA, 17 bp, Artificial sequence
  Synthesized sequence
gtggctccgcgcgtcct

SEQ ID NO: 4656 - DNA, 17 bp, Artificial sequence
  Synthesized sequence
tcggcgcggtgcatgcc

SEQ ID NO: 4657 - DNA, 17 bp, Artificial sequence
  Synthesized sequence
ctggcggtacgcttcca

SEQ ID NO: 4658 - DNA, 17 bp, Artificial sequence
  Synthesized sequence
ctgtcacggtagcttca

SEQ ID NO: 4659 - DNA, 17 bp, Artificial sequence
  Synthesized sequence
ctgccaccgcgcttggc

SEQ ID NO: 4660 - DNA, 17 bp, Artificial sequence
  Synthesized sequence
ctggcgcgctttgagcc

SEQ ID NO: 4661 - DNA, 17 bp, Artificial sequence
  Synthesized sequence
ctggcctgcagcctgtt

SEQ ID NO: 4662 - DNA, 17 bp, Artificial sequence
  Synthesized sequence
gtggaaaccctgctgcg

SEQ ID NO: 4663 - DNA, 17 bp, Artificial sequence
  Synthesized sequence
ctggccctggccgcgct

SEQ ID NO: 4664 - DNA, 17 bp, Artificial sequence
  Synthesized sequence
gtggctggacttcagct

SEQ ID NO: 4665 - DNA, 17 bp, Artificial sequence
  Synthesized sequence
ctgctgcgtcggttgca

SEQ ID NO: 4666 - DNA, 17 bp, Artificial sequence
  Synthesized sequence
ctgcaagggttcctgct

SEQ ID NO: 4667 - DNA, 17 bp, Artificial sequence
  Synthesized sequence
ccggcgcggtctatgcc

SEQ ID NO: 4668 - DNA, 17 bp, Artificial sequence
  Synthesized sequence
ctggccttccgcatgcg

SEQ ID NO: 4669 - DNA, 17 bp, Artificial sequence
  Synthesized sequence
cgggcactgctcgtcca

SEQ ID NO: 4670 - DNA, 17 bp, Artificial sequence
  Synthesized sequence
ctggcgcgagtggagcc

SEQ ID NO: 4671 - DNA, 17 bp, Artificial sequence
  Synthesized sequence
tcggcatgatcgtttcg

SEQ ID NO: 4672 - DNA, 17 bp, Artificial sequence
  Synthesized sequence
gcggcagggctgctggt

SEQ ID NO: 4673 - DNA, 17 bp, Artificial sequence
  Synthesized sequence
ctggatcagcaggtgcg

SEQ ID NO: 4674 - DNA, 17 bp, Artificial sequence
  Synthesized sequence
ctggaaagccagttccc

SEQ ID NO: 4675 - DNA, 17 bp, Artificial sequence
  Synthesized sequence
ccggccgggttgctgct

SEQ ID NO: 4676 - DNA, 17 bp, Artificial sequence
  Synthesized sequence
atgacccgcctgctgcg

SEQ ID NO: 4677 - DNA, 17 bp, Artificial sequence
  Synthesized sequence
ccggtatggcgcttgta

SEQ ID NO: 4678 - DNA, 17 bp, Artificial sequence
  Synthesized sequence
ctggaaggggtcaagct

SEQ ID NO: 4679 - DNA, 17 bp, Artificial sequence
  Synthesized sequence
cggccagcactattgct

SEQ ID NO: 4680 - DNA, 17 bp, Artificial sequence
  Synthesized sequence
ctggcaagaaaggtggc

SEQ ID NO: 4681 - DNA, 17 bp, Artificial sequence
  Synthesized sequence
tcgggacggtcctggcg

SEQ ID NO: 4682 - DNA, 17 bp, Artificial sequence
  Synthesized sequence
tcgggacggtcctggcg

SEQ ID NO: 4683 - DNA, 17 bp, Artificial sequence
  Synthesized sequence
ctggcacctgccgttcg

SEQ ID NO: 4684 - DNA, 17 bp, Artificial sequence
  Synthesized sequence
gtgcccggacagttgcc

SEQ ID NO: 4685 - DNA, 17 bp, Artificial sequence
  Synthesized sequence
ccggcgcagcgcctgcg

SEQ ID NO: 4686 - DNA, 17 bp, Artificial sequence
  Synthesized sequence
ctggagtgggcggtgca

SEQ ID NO: 4687 - DNA, 17 bp, Artificial sequence
  Synthesized sequence
gtggcccgcaacatggc

SEQ ID NO: 4688 - DNA, 17 bp, Artificial sequence
  Synthesized sequence
agggcgccaccctggct

SEQ ID NO: 4689 - DNA, 17 bp, Artificial sequence
  Synthesized sequence
ctggaaaaatcgctgcc

SEQ ID NO: 4690 - DNA, 17 bp, Artificial sequence
  Synthesized sequence
ctggaaaaatcgctgcc

SEQ ID NO: 4691 - DNA, 17 bp, Artificial sequence
  Synthesized sequence
ctggcagcgcttcggcg

SEQ ID NO: 4692 - DNA, 17 bp, Artificial sequence
  Synthesized sequence
gtggcgttctatttcca

SEQ ID NO: 4693 - DNA, 17 bp, Artificial sequence
  Synthesized sequence
ctcgaacagggcgtgca

SEQ ID NO: 4694 - DNA, 17 bp, Artificial sequence
  Synthesized sequence
gtggctcggcgcgagcc

SEQ ID NO: 4695 - DNA, 17 bp, Artificial sequence
  Synthesized sequence
ctgctctggccgttgct

SEQ ID NO: 4696 - DNA, 17 bp, Artificial sequence
  Synthesized sequence
gcggcgcggcgctggcc

SEQ ID NO: 4697 - DNA, 17 bp, Artificial sequence
  Synthesized sequence
atggccgagttcttccc

SEQ ID NO: 4698 - DNA, 17 bp, Artificial sequence
  Synthesized sequence
ctggcgcattccaagct

SEQ ID NO: 4699 - DNA, 17 bp, Artificial sequence
  Synthesized sequence
gtcgccatcccgttgct

SEQ ID NO: 4700 - DNA, 17 bp, Artificial sequence
  Synthesized sequence
cggacatgcccattgcc

SEQ ID NO: 4701 - DNA, 17 bp, Artificial sequence
  Synthesized sequence
ggggcgcatgccctgct

SEQ ID NO: 4702 - DNA, 17 bp, Artificial sequence
  Synthesized sequence
atggaaccgcaggcgca

SEQ ID NO: 4703 - DNA, 17 bp, Artificial sequence
  Synthesized sequence
atagcatcagttttgga

SEQ ID NO: 4704 - DNA, 17 bp, Artificial sequence
  Synthesized sequence
ctggaaggcctgccgct

SEQ ID NO: 4705 - DNA, 17 bp, Artificial sequence
  Synthesized sequence
agggcaagccgttcgcc

SEQ ID NO: 4706 - DNA, 17 bp, Artificial sequence
  Synthesized sequence
gaggcgtgggtttcgca

SEQ ID NO: 4707 - DNA, 17 bp, Artificial sequence
  Synthesized sequence
tcggcctgcccttcgct

SEQ ID NO: 4708 - DNA, 17 bp, Artificial sequence
  Synthesized sequence
atggcaagaagctggac

SEQ ID NO: 4709 - DNA, 17 bp, Artificial sequence
  Synthesized sequence
ccggcgcgactgttggc

SEQ ID NO: 4710 - DNA, 17 bp, Artificial sequence
  Synthesized sequence
ctcgaacactgcctgct

SEQ ID NO: 4711 - DNA, 17 bp, Artificial sequence
  Synthesized sequence
ttggcaaagccccttcg

SEQ ID NO: 4712 - DNA, 17 bp, Artificial sequence
  Synthesized sequence
ttggctcagatcatgag

SEQ ID NO: 4713 - DNA, 17 bp, Artificial sequence
  Synthesized sequence
cgggcgcagcgcctgcg

SEQ ID NO: 4714 - DNA, 17 bp, Artificial sequence
  Synthesized sequence
gtggcgcagggggtact

SEQ ID NO: 4715 - DNA, 17 bp, Artificial sequence
  Synthesized sequence
gcggcgccgacgatgct

SEQ ID NO: 4716 - DNA, 17 bp, Artificial sequence
  Synthesized sequence
tgggccgatggcttgca

SEQ ID NO: 4717 - DNA, 17 bp, Artificial sequence
  Synthesized sequence
atggaacacctcaagcg

SEQ ID NO: 4718 - DNA, 17 bp, Artificial sequence
  Synthesized sequence
caggcagcagccgtgca

SEQ ID NO: 4719 - DNA, 17 bp, Artificial sequence
  Synthesized sequence
tcggcaagaaccttacc

SEQ ID NO: 4720 - DNA, 17 bp, Artificial sequence
  Synthesized sequence
ctggaccgctactggcg

SEQ ID NO: 4721 - DNA, 17 bp, Artificial sequence
  Synthesized sequence
ctgggcctggcggtgct

SEQ ID NO: 4722 - DNA, 17 bp, Artificial sequence
  Synthesized sequence
gtggttcgccaatcgcg

SEQ ID NO: 4723 - DNA, 17 bp, Artificial sequence
  Synthesized sequence
ctggtccgtcactggcg

SEQ ID NO: 4724 - DNA, 17 bp, Artificial sequence
  Synthesized sequence
ccggcaagccgatcgcc

SEQ ID NO: 4725 - DNA, 17 bp, Artificial sequence
  Synthesized sequence
attgcaacgttgtcgca

SEQ ID NO: 4726 - DNA, 17 bp, Artificial sequence
  Synthesized sequence
ccggccaccactttgca

SEQ ID NO: 4727 - DNA, 17 bp, Artificial sequence
  Synthesized sequence
agggcgttttcgttgca

SEQ ID NO: 4728 - DNA, 17 bp, Artificial sequence
  Synthesized sequence
cagccacgatgatcgct

SEQ ID NO: 4729 - DNA, 17 bp, Artificial sequence
  Synthesized sequence
ctggccctgccgctgta

SEQ ID NO: 4730 - DNA, 17 bp, Artificial sequence
  Synthesized sequence
ctggtcggagccctgct

SEQ ID NO: 4731 - DNA, 17 bp, Artificial sequence
  Synthesized sequence
tcggcgcggcgctggcc

SEQ ID NO: 4732 - DNA, 17 bp, Artificial sequence
  Synthesized sequence
tcggcgcggcgctggcc

SEQ ID NO: 4733 - DNA, 17 bp, Artificial sequence
  Synthesized sequence
cgagcacggcagttgga

SEQ ID NO: 4734 - DNA, 17 bp, Artificial sequence
  Synthesized sequence
ccggccgggctatggct

SEQ ID NO: 4735 - DNA, 17 bp, Artificial sequence
  Synthesized sequence
caggccgcgctcttgcc

SEQ ID NO: 4736 - DNA, 17 bp, Artificial sequence
  Synthesized sequence
atgccacctatttcgcc

SEQ ID NO: 4737 - DNA, 17 bp, Artificial sequence
  Synthesized sequence
ccggcaagcacctcgcc

SEQ ID NO: 4738 - DNA, 17 bp, Artificial sequence
  Synthesized sequence
cgggcagcactttttca

SEQ ID NO: 4739 - DNA, 17 bp, Artificial sequence
  Synthesized sequence
atcgcccaggcgctgct

SEQ ID NO: 4740 - DNA, 17 bp, Artificial sequence
  Synthesized sequence
ctggcgcagccgtcgaa

SEQ ID NO: 4741 - DNA, 17 bp, Artificial sequence
  Synthesized sequence
tgggcgcgaccgatgcc

SEQ ID NO: 4742 - DNA, 17 bp, Artificial sequence
  Synthesized sequence
atcgaccatcagttgct

SEQ ID NO: 4743 - DNA, 17 bp, Artificial sequence
  Synthesized sequence
ctggcgaaagccctgcc

SEQ ID NO: 4744 - DNA, 17 bp, Artificial sequence
  Synthesized sequence
gtggcccgggcaaggcg

SEQ ID NO: 4745 - DNA, 17 bp, Artificial sequence
  Synthesized sequence
cttgccgaagggttgca

SEQ ID NO: 4746 - DNA, 17 bp, Artificial sequence
  Synthesized sequence
cttgccgtccagttgct

SEQ ID NO: 4747 - DNA, 17 bp, Artificial sequence
  Synthesized sequence
ctggcgggtcgctcgcc

SEQ ID NO: 4748 - DNA, 17 bp, Artificial sequence
  Synthesized sequence
aaggaaaacaccttgcg

SEQ ID NO: 4749 - DNA, 17 bp, Artificial sequence
  Synthesized sequence
ctcgcgcggaccctgcc

SEQ ID NO: 4750 - DNA, 17 bp, Artificial sequence
  Synthesized sequence
gcggcccgggcggtgcc

SEQ ID NO: 4751 - DNA, 17 bp, Artificial sequence
  Synthesized sequence
gcggcgcaccgcttcct

SEQ ID NO: 4752 - DNA, 17 bp, Artificial sequence
  Synthesized sequence
ctggctcgacggccgcc

SEQ ID NO: 4753 - DNA, 17 bp, Artificial sequence
  Synthesized sequence
ctgttgcaggcattgct

SEQ ID NO: 4754 - DNA, 17 bp, Artificial sequence
  Synthesized sequence
tcggctgcgctcttgcg

SEQ ID NO: 4755 - DNA, 17 bp, Artificial sequence
  Synthesized sequence
cggccacgcctcgtgcg

SEQ ID NO: 4756 - DNA, 17 bp, Artificial sequence
  Synthesized sequence
ctggcgttccgcgtgcg

SEQ ID NO: 4757 - DNA, 17 bp, Artificial sequence
  Synthesized sequence
ctgggacgccgattatt

SEQ ID NO: 4758 - DNA, 17 bp, Artificial sequence
  Synthesized sequence
atggcaaacctctcggg

SEQ ID NO: 4759 - DNA, 17 bp, Artificial sequence
  Synthesized sequence
ttcgcgcagttctttct

SEQ ID NO: 4760 - DNA, 17 bp, Artificial sequence
  Synthesized sequence
cgggcgaaggtgttgcc

SEQ ID NO: 4761 - DNA, 17 bp, Artificial sequence
  Synthesized sequence
ttcgagcggcgcttgcg

SEQ ID NO: 4762 - DNA, 17 bp, Artificial sequence
  Synthesized sequence
ccggcggagggcttgcg

SEQ ID NO: 4763 - DNA, 17 bp, Artificial sequence
  Synthesized sequence
ctggaaatgtaatttca

SEQ ID NO: 4764 - DNA, 17 bp, Artificial sequence
  Synthesized sequence
gtgccaagcgcgttgaa

SEQ ID NO: 4765 - DNA, 17 bp, Artificial sequence
  Synthesized sequence
ctggccctggtggtgtt

SEQ ID NO: 4766 - DNA, 17 bp, Artificial sequence
  Synthesized sequence
gtggaaagcagctttcc

SEQ ID NO: 4767 - DNA, 17 bp, Artificial sequence
  Synthesized sequence
gtggcggccctgctgcg

SEQ ID NO: 4768 - DNA, 17 bp, Artificial sequence
  Synthesized sequence
ctgatacggaccatgcg

SEQ ID NO: 4769 - DNA, 17 bp, Artificial sequence
  Synthesized sequence
tcgccacggcgattggt

SEQ ID NO: 4770 - DNA, 17 bp, Artificial sequence
  Synthesized sequence
atggccggggtcaggca

SEQ ID NO: 4771 - DNA, 17 bp, Artificial sequence
  Synthesized sequence
agggcttaagatttgcc

SEQ ID NO: 4772 - DNA, 17 bp, Artificial sequence
  Synthesized sequence
tgggctcggagactgcg

SEQ ID NO: 4773 - DNA, 17 bp, Artificial sequence
  Synthesized sequence
cgggcatggcgcgtgtt

SEQ ID NO: 4774 - DNA, 17 bp, Artificial sequence
  Synthesized sequence
ctgctgcggttgttgcg

SEQ ID NO: 4775 - DNA, 17 bp, Artificial sequence
  Synthesized sequence
gtagcccgtggaatgct

SEQ ID NO: 4776 - DNA, 17 bp, Artificial sequence
  Synthesized sequence
gtagcccgtggaatgct

SEQ ID NO: 4777 - DNA, 17 bp, Artificial sequence
  Synthesized sequence
ctggtacgactatcggc

SEQ ID NO: 4778 - DNA, 17 bp, Artificial sequence
  Synthesized sequence
ctggcgcagggtcagca

SEQ ID NO: 4779 - DNA, 17 bp, Artificial sequence
  Synthesized sequence
caggcatatccgctgcg

SEQ ID NO: 4780 - DNA, 17 bp, Artificial sequence
  Synthesized sequence
cgggcaaccagggtgct

SEQ ID NO: 4781 - DNA, 17 bp, Artificial sequence
  Synthesized sequence
ctggccgagggtctgcg

SEQ ID NO: 4782 - DNA, 17 bp, Artificial sequence
  Synthesized sequence
tcggtccggaggttgcc

SEQ ID NO: 4783 - DNA, 17 bp, Artificial sequence
  Synthesized sequence
gtggctcggtagacgcc

SEQ ID NO: 4784 - DNA, 17 bp, Artificial sequence
  Synthesized sequence
tcggcagggcggtggcc

SEQ ID NO: 4785 - DNA, 17 bp, Artificial sequence
  Synthesized sequence
ctggcggtacggtagca

SEQ ID NO: 4786 - DNA, 17 bp, Artificial sequence
  Synthesized sequence
atgacgctccttatgct

SEQ ID NO: 4787 - DNA, 17 bp, Artificial sequence
  Synthesized sequence
gaggccagccgcctgct

SEQ ID NO: 4788 - DNA, 17 bp, Artificial sequence
  Synthesized sequence
gtggcggggctgatgtt

SEQ ID NO: 4789 - DNA, 17 bp, Artificial sequence
  Synthesized sequence
cacgcaacccttttgca

SEQ ID NO: 4790 - DNA, 17 bp, Artificial sequence
  Synthesized sequence
tcggccgatgcgttgca

SEQ ID NO: 4791 - DNA, 17 bp, Artificial sequence
  Synthesized sequence
ctggccctcctgcagca

SEQ ID NO: 4792 - DNA, 17 bp, Artificial sequence
  Synthesized sequence
atggccccggtcatcca

SEQ ID NO: 4793 - DNA, 17 bp, Artificial sequence
  Synthesized sequence
ctggtgcaccccctgcc

SEQ ID NO: 4794 - DNA, 17 bp, Artificial sequence
  Synthesized sequence
gtggctcacgcccggca

SEQ ID NO: 4795 - DNA, 17 bp, Artificial sequence
  Synthesized sequence
gtggtgccgaccttcct

SEQ ID NO: 4796 - DNA, 17 bp, Artificial sequence
  Synthesized sequence
cggggatggctgtagca

SEQ ID NO: 4797 - DNA, 17 bp, Artificial sequence
  Synthesized sequence
ctggcagcgtccgttca

SEQ ID NO: 4798 - DNA, 17 bp, Artificial sequence
  Synthesized sequence
gtggcttcgccggtgcg

SEQ ID NO: 4799 - DNA, 17 bp, Artificial sequence
  Synthesized sequence
gtcgcgcaggcgctgct

SEQ ID NO: 4800 - DNA, 17 bp, Artificial sequence
  Synthesized sequence
ccggcaataacgtggct

SEQ ID NO: 4801 - DNA, 17 bp, Artificial sequence
  Synthesized sequence
ctcgcgcagctatttca

SEQ ID NO: 4802 - DNA, 17 bp, Artificial sequence
  Synthesized sequence
atggccctgtatccgca

SEQ ID NO: 4803 - DNA, 17 bp, Artificial sequence
  Synthesized sequence
ctggcaggcccgctacg

SEQ ID NO: 4804 - DNA, 17 bp, Artificial sequence
  Synthesized sequence
gtcgccccgctgctgca

SEQ ID NO: 4805 - DNA, 17 bp, Artificial sequence
  Synthesized sequence
acggcgcggcgttcgcc

SEQ ID NO: 4806 - DNA, 17 bp, Artificial sequence
  Synthesized sequence
ccggcacaagacatcct

SEQ ID NO: 4807 - DNA, 17 bp, Artificial sequence
  Synthesized sequence
ctggcgctgctggtgga

SEQ ID NO: 4808 - DNA, 17 bp, Artificial sequence
  Synthesized sequence
ccggcaggcgttttggc

SEQ ID NO: 4809 - DNA, 17 bp, Artificial sequence
  Synthesized sequence
gtggccagtccatggcc

SEQ ID NO: 4810 - DNA, 17 bp, Artificial sequence
  Synthesized sequence
gtgccagggccctggcc

SEQ ID NO: 4811 - DNA, 17 bp, Artificial sequence
  Synthesized sequence
atgactcgaagctttct

SEQ ID NO: 4812 - DNA, 17 bp, Artificial sequence
  Synthesized sequence
caggcaaatccttttct

SEQ ID NO: 4813 - DNA, 17 bp, Artificial sequence
  Synthesized sequence
ttggccatcgcctggct

SEQ ID NO: 4814 - DNA, 17 bp, Artificial sequence
  Synthesized sequence
taggcgcgattttcgcg

SEQ ID NO: 4815 - DNA, 17 bp, Artificial sequence
  Synthesized sequence
gtggatcggttctttcc

SEQ ID NO: 4816 - DNA, 17 bp, Artificial sequence
  Synthesized sequence
tgcgcgcgggcattgca

SEQ ID NO: 4817 - DNA, 17 bp, Artificial sequence
  Synthesized sequence
atggaacccaacccgca

SEQ ID NO: 4818 - DNA, 17 bp, Artificial sequence
  Synthesized sequence
atgccgcttcgcttgcc

SEQ ID NO: 4819 - DNA, 17 bp, Artificial sequence
  Synthesized sequence
cagggcgggcaattgct

SEQ ID NO: 4820 - DNA, 17 bp, Artificial sequence
  Synthesized sequence
gtggcactgactttatg

SEQ ID NO: 4821 - DNA, 17 bp, Artificial sequence
  Synthesized sequence
ctgggccagcggtttca

SEQ ID NO: 4822 - DNA, 17 bp, Artificial sequence
  Synthesized sequence
ccggcacgggcgtcgaa

SEQ ID NO: 4823 - DNA, 17 bp, Artificial sequence
  Synthesized sequence
tcggcacgcatcctggc

SEQ ID NO: 4824 - DNA, 17 bp, Artificial sequence
  Synthesized sequence
ctgcggcaggccttgca

SEQ ID NO: 4825 - DNA, 17 bp, Artificial sequence
  Synthesized sequence
ctggcataatcgacgcc

SEQ ID NO: 4826 - DNA, 17 bp, Artificial sequence
  Synthesized sequence
ttggccgagctatttcc

SEQ ID NO: 4827 - DNA, 17 bp, Artificial sequence
  Synthesized sequence
ctggccggcctgctgat

SEQ ID NO: 4828 - DNA, 17 bp, Artificial sequence
  Synthesized sequence
cgggctcggcgtctgcc

SEQ ID NO: 4829 - DNA, 17 bp, Artificial sequence
  Synthesized sequence
cgggaaagcggattgcg

SEQ ID NO: 4830 - DNA, 17 bp, Artificial sequence
  Synthesized sequence
ttggcaaatattttttt

SEQ ID NO: 4831 - DNA, 17 bp, Artificial sequence
  Synthesized sequence
ctggctggaaccttccc

SEQ ID NO: 4832 - DNA, 17 bp, Artificial sequence
  Synthesized sequence
cgggtacagaacctgcg

SEQ ID NO: 4833 - DNA, 17 bp, Artificial sequence
  Synthesized sequence
atggcgcggctatgccg

SEQ ID NO: 4834 - DNA, 17 bp, Artificial sequence
  Synthesized sequence
ctggaaggcgttttccc

SEQ ID NO: 4835 - DNA, 17 bp, Artificial sequence
  Synthesized sequence
cgggcgcggaggatgcc

SEQ ID NO: 4836 - DNA, 17 bp, Artificial sequence
  Synthesized sequence
gtggcaacggtttcaca

SEQ ID NO: 4837 - DNA, 17 bp, Artificial sequence
  Synthesized sequence
gtggaacaggctctcca

SEQ ID NO: 4838 - DNA, 17 bp, Artificial sequence
  Synthesized sequence
attgccccgcaagtgct

SEQ ID NO: 4839 - DNA, 17 bp, Artificial sequence
  Synthesized sequence
caggaacgacgaatgcg

SEQ ID NO: 4840 - DNA, 17 bp, Artificial sequence
  Synthesized sequence
tcggggcggtccttgcc

SEQ ID NO: 4841 - DNA, 17 bp, Artificial sequence
  Synthesized sequence
ttggaacgggtggagcc

SEQ ID NO: 4842 - DNA, 17 bp, Artificial sequence
  Synthesized sequence
cgcgcaccccagttgcc

SEQ ID NO: 4843 - DNA, 17 bp, Artificial sequence
  Synthesized sequence
atttcacgaccctcgca

SEQ ID NO: 4844 - DNA, 17 bp, Artificial sequence
  Synthesized sequence
caggcacgcatcgagcg

SEQ ID NO: 4845 - DNA, 17 bp, Artificial sequence
  Synthesized sequence
ttggcgccgccggtgat

SEQ ID NO: 4846 - DNA, 17 bp, Artificial sequence
  Synthesized sequence
ctggctcggcgggcgcc

SEQ ID NO: 4847 - DNA, 17 bp, Artificial sequence
  Synthesized sequence
gtggtcggcctgtggct

SEQ ID NO: 4848 - DNA, 17 bp, Artificial sequence
  Synthesized sequence
ctggcccgggaactggg

SEQ ID NO: 4849 - DNA, 17 bp, Artificial sequence
  Synthesized sequence
ttggcgagcggctggcg

SEQ ID NO: 4850 - DNA, 17 bp, Artificial sequence
  Synthesized sequence
agggcacgacgcgcgcg

SEQ ID NO: 4851 - DNA, 17 bp, Artificial sequence
  Synthesized sequence
ctggcccagcgtttcgt

SEQ ID NO: 4852 - DNA, 17 bp, Artificial sequence
  Synthesized sequence
ccggcaagatcgtcgcc

SEQ ID NO: 4853 - DNA, 17 bp, Artificial sequence
  Synthesized sequence
gtggctgagatctttcc

SEQ ID NO: 4854 - DNA, 17 bp, Artificial sequence
  Synthesized sequence
tacgcccaggaattgct

SEQ ID NO: 4855 - DNA, 17 bp, Artificial sequence
  Synthesized sequence
ctggccggcctcaagca

SEQ ID NO: 4856 - DNA, 17 bp, Artificial sequence
  Synthesized sequence
gcggcgcaccagttcct

SEQ ID NO: 4857 - DNA, 17 bp, Artificial sequence
  Synthesized sequence
tacgcattccgcttgca

SEQ ID NO: 4858 - DNA, 17 bp, Artificial sequence
  Synthesized sequence
ccggccggtccgttgcg

SEQ ID NO: 4859 - DNA, 17 bp, Artificial sequence
  Synthesized sequence
atggcgtggttttcgaa

SEQ ID NO: 4860 - DNA, 17 bp, Artificial sequence
  Synthesized sequence
tcggaccgagccttgcc

SEQ ID NO: 4861 - DNA, 17 bp, Artificial sequence
  Synthesized sequence
gtggacctgagcttcct

SEQ ID NO: 4862 - DNA, 17 bp, Artificial sequence
  Synthesized sequence
ctggcctgggccgggct

SEQ ID NO: 4863 - DNA, 17 bp, Artificial sequence
  Synthesized sequence
gaggcgtgatggctgct

SEQ ID NO: 4864 - DNA, 17 bp, Artificial sequence
  Synthesized sequence
ctggcgcgtgcacttca

SEQ ID NO: 4865 - DNA, 17 bp, Artificial sequence
  Synthesized sequence
cgggcatgttcctggcc

SEQ ID NO: 4866 - DNA, 17 bp, Artificial sequence
  Synthesized sequence
ctggtcgaactgctgct

SEQ ID NO: 4867 - DNA, 17 bp, Artificial sequence
  Synthesized sequence
ctcgcatgtctatggcg

SEQ ID NO: 4868 - DNA, 17 bp, Artificial sequence
  Synthesized sequence
gtggcctgcctgctgga

SEQ ID NO: 4869 - DNA, 17 bp, Artificial sequence
  Synthesized sequence
aaggcgcggtcgatgcg

SEQ ID NO: 4870 - DNA, 17 bp, Artificial sequence
  Synthesized sequence
ctggaggaactcctgca

SEQ ID NO: 4871 - DNA, 17 bp, Artificial sequence
  Synthesized sequence
gaggcacggttgcagcc

SEQ ID NO: 4872 - DNA, 17 bp, Artificial sequence
  Synthesized sequence
ctgtcgctgctggtgct

SEQ ID NO: 4873 - DNA, 17 bp, Artificial sequence
  Synthesized sequence
ctggaacagcgctacca

SEQ ID NO: 4874 - DNA, 17 bp, Artificial sequence
  Synthesized sequence
ctgacctggtacctgca

SEQ ID NO: 4875 - DNA, 17 bp, Artificial sequence
  Synthesized sequence
gcggcacgagcgtcgga

SEQ ID NO: 4876 - DNA, 17 bp, Artificial sequence
  Synthesized sequence
ctggccgccctgctgcc

SEQ ID NO: 4877 - DNA, 17 bp, Artificial sequence
  Synthesized sequence
ctggcacgacattccga

SEQ ID NO: 4878 - DNA, 17 bp, Artificial sequence
  Synthesized sequence
ccggcaggtctgtcgcc

SEQ ID NO: 4879 - DNA, 17 bp, Artificial sequence
  Synthesized sequence
cgggcagaaccatttca

SEQ ID NO: 4880 - DNA, 17 bp, Artificial sequence
  Synthesized sequence
ctggaaagcctgccgct

SEQ ID NO: 4881 - DNA, 17 bp, Artificial sequence
  Synthesized sequence
ctggcgcgcaccgcgcg

SEQ ID NO: 4882 - DNA, 17 bp, Artificial sequence
  Synthesized sequence
caggcacaggaacagca

SEQ ID NO: 4883 - DNA, 17 bp, Artificial sequence
  Synthesized sequence
aagccacgcccatcgca

SEQ ID NO: 4884 - DNA, 17 bp, Artificial sequence
  Synthesized sequence
ctggccccggtacagca

SEQ ID NO: 4885 - DNA, 17 bp, Artificial sequence
  Synthesized sequence
ctggccgaggcgctgcg

SEQ ID NO: 4886 - DNA, 17 bp, Artificial sequence
  Synthesized sequence
ctggggccgcatttcct

SEQ ID NO: 4887 - DNA, 17 bp, Artificial sequence
  Synthesized sequence
gtggcccggccgatccg

SEQ ID NO: 4888 - DNA, 17 bp, Artificial sequence
  Synthesized sequence
ctcgcccacctgtggca

SEQ ID NO: 4889 - DNA, 17 bp, Artificial sequence
  Synthesized sequence
ctggcatatccgcggcg

SEQ ID NO: 4890 - DNA, 17 bp, Artificial sequence
  Synthesized sequence
gtgccaagggagatgcc

SEQ ID NO: 4891 - DNA, 17 bp, Artificial sequence
  Synthesized sequence
tggccattccggttgct

SEQ ID NO: 4892 - DNA, 17 bp, Artificial sequence
  Synthesized sequence
tcggcacgccgtttatt

SEQ ID NO: 4893 - DNA, 17 bp, Artificial sequence
  Synthesized sequence
atggaactactttcgtt

SEQ ID NO: 4894 - DNA, 17 bp, Artificial sequence
  Synthesized sequence
ttgcctcccgacttgcc

SEQ ID NO: 4895 - DNA, 17 bp, Artificial sequence
  Synthesized sequence
ccgccagggcctttgcc

SEQ ID NO: 4896 - DNA, 17 bp, Artificial sequence
  Synthesized sequence
atggccgaggaaatgcc

SEQ ID NO: 4897 - DNA, 17 bp, Artificial sequence
  Synthesized sequence
gcggctctggatctgct

SEQ ID NO: 4898 - DNA, 17 bp, Artificial sequence
  Synthesized sequence
ctgggaaggtttccgct

SEQ ID NO: 4899 - DNA, 17 bp, Artificial sequence
  Synthesized sequence
ccggcacgccgccggcg

SEQ ID NO: 4900 - DNA, 17 bp, Artificial sequence
  Synthesized sequence
ctggcgctgcaggagct

SEQ ID NO: 4901 - DNA, 17 bp, Artificial sequence
  Synthesized sequence
gtggcaccgccccaggt

SEQ ID NO: 4902 - DNA, 17 bp, Artificial sequence
  Synthesized sequence
ccggcccggcgctttcg

SEQ ID NO: 4903 - DNA, 17 bp, Artificial sequence
  Synthesized sequence
ccggcccggcgctttcg

SEQ ID NO: 4904 - DNA, 17 bp, Artificial sequence
  Synthesized sequence
ctggccctggccgggct

SEQ ID NO: 4905 - DNA, 17 bp, Artificial sequence
  Synthesized sequence
ctggcgctgccgctggt

SEQ ID NO: 4906 - DNA, 17 bp, Artificial sequence
  Synthesized sequence
ccggcacgccacaggcc

SEQ ID NO: 4907 - DNA, 17 bp, Artificial sequence
  Synthesized sequence
gaagcaggcctattgcg

SEQ ID NO: 4908 - DNA, 17 bp, Artificial sequence
  Synthesized sequence
gtggcatgggcgtggtc

SEQ ID NO: 4909 - DNA, 17 bp, Artificial sequence
  Synthesized sequence
ctggagcaggccctgcg

SEQ ID NO: 4910 - DNA, 17 bp, Artificial sequence
  Synthesized sequence
ctggcacggatcgaggc

SEQ ID NO: 4911 - DNA, 17 bp, Artificial sequence
  Synthesized sequence
gtggcgagcccgttacg

SEQ ID NO: 4912 - DNA, 17 bp, Artificial sequence
  Synthesized sequence
gtgggtcgagcgctgcg

SEQ ID NO: 4913 - DNA, 17 bp, Artificial sequence
  Synthesized sequence
ccggcccgccctgtgcc

SEQ ID NO: 4914 - DNA, 17 bp, Artificial sequence
  Synthesized sequence
caggccagccgcctgct

SEQ ID NO: 4915 - DNA, 17 bp, Artificial sequence
  Synthesized sequence
tcggcgcggcgctggcc

SEQ ID NO: 4916 - DNA, 17 bp, Artificial sequence
  Synthesized sequence
ctggccagcgtcgcgct

SEQ ID NO: 4917 - DNA, 17 bp, Artificial sequence
  Synthesized sequence
gaggcattcagcttcct

SEQ ID NO: 4918 - DNA, 17 bp, Artificial sequence
  Synthesized sequence
gtcgaacacttctggca

SEQ ID NO: 4919 - DNA, 17 bp, Artificial sequence
  Synthesized sequence
ctggccggtccatcgcc

SEQ ID NO: 4920 - DNA, 17 bp, Artificial sequence
  Synthesized sequence
ctggcctatcgctggcc

SEQ ID NO: 4921 - DNA, 17 bp, Artificial sequence
  Synthesized sequence
ctggaatatccttggcg

SEQ ID NO: 4922 - DNA, 17 bp, Artificial sequence
  Synthesized sequence
ttggccgatgccttcca

SEQ ID NO: 4923 - DNA, 17 bp, Artificial sequence
  Synthesized sequence
ctggccgacgccctgcg

SEQ ID NO: 4924 - DNA, 17 bp, Artificial sequence
  Synthesized sequence
atcgcccacggcatgct

SEQ ID NO: 4925 - DNA, 17 bp, Artificial sequence
  Synthesized sequence
gtgtcatgcacctggcc

SEQ ID NO: 4926 - DNA, 17 bp, Artificial sequence
  Synthesized sequence
gtggacctggcgctgca

SEQ ID NO: 4927 - DNA, 17 bp, Artificial sequence
  Synthesized sequence
gaggctcacggcatgca

SEQ ID NO: 4928 - DNA, 17 bp, Artificial sequence
  Synthesized sequence
atggcacgctcaagcct

SEQ ID NO: 4929 - DNA, 17 bp, Artificial sequence
  Synthesized sequence
ctgcaacacctctttca

SEQ ID NO: 4930 - DNA, 17 bp, Artificial sequence
  Synthesized sequence
ctggccggcgtttttcc

SEQ ID NO: 4931 - DNA, 17 bp, Artificial sequence
  Synthesized sequence
caggcgcgcgccgtgcg

SEQ ID NO: 4932 - DNA, 17 bp, Artificial sequence
  Synthesized sequence
ctggcgcgccaacggcc

SEQ ID NO: 4933 - DNA, 17 bp, Artificial sequence
  Synthesized sequence
ccggccagcctgctgca

SEQ ID NO: 4934 - DNA, 17 bp, Artificial sequence
  Synthesized sequence
acggcccgaccttcgcc

SEQ ID NO: 4935 - DNA, 17 bp, Artificial sequence
  Synthesized sequence
ctgacccacaccctgca

SEQ ID NO: 4936 - DNA, 17 bp, Artificial sequence
  Synthesized sequence
ctggcgccctacacgct

SEQ ID NO: 4937 - DNA, 17 bp, Artificial sequence
  Synthesized sequence
ctggaggcctcgttgca

SEQ ID NO: 4938 - DNA, 17 bp, Artificial sequence
  Synthesized sequence
ctggcccgcaccctggc

SEQ ID NO: 4939 - DNA, 17 bp, Artificial sequence
  Synthesized sequence
caggcactgttcgagca

SEQ ID NO: 4940 - DNA, 17 bp, Artificial sequence
  Synthesized sequence
atgtcgcggtgcttcca

SEQ ID NO: 4941 - DNA, 17 bp, Artificial sequence
  Synthesized sequence
ctggagcactacttcca

SEQ ID NO: 4942 - DNA, 17 bp, Artificial sequence
  Synthesized sequence
ctggtacgccgtcggcg

SEQ ID NO: 4943 - DNA, 17 bp, Artificial sequence
  Synthesized sequence
ccagaacagggcttgct

SEQ ID NO: 4944 - DNA, 17 bp, Artificial sequence
  Synthesized sequence
atcgacccgcagttgct

SEQ ID NO: 4945 - DNA, 17 bp, Artificial sequence
  Synthesized sequence
ctggcgcgacagcttcg

SEQ ID NO: 4946 - DNA, 17 bp, Artificial sequence
  Synthesized sequence
atcgaactgctgatgca

SEQ ID NO: 4947 - DNA, 17 bp, Artificial sequence
  Synthesized sequence
gtggcgttcaccgtgcg

SEQ ID NO: 4948 - DNA, 17 bp, Artificial sequence
  Synthesized sequence
ctggagcagttctcgcc

SEQ ID NO: 4949 - DNA, 17 bp, Artificial sequence
  Synthesized sequence
gtggccaaggtttcgcc

SEQ ID NO: 4950 - DNA, 17 bp, Artificial sequence
  Synthesized sequence
ttggcagatcttccgcc

SEQ ID NO: 4951 - DNA, 17 bp, Artificial sequence
  Synthesized sequence
atggcccaggcgatcct

SEQ ID NO: 4952 - DNA, 17 bp, Artificial sequence
  Synthesized sequence
ctggcccgaaccctggc

SEQ ID NO: 4953 - DNA, 17 bp, Artificial sequence
  Synthesized sequence
gcggcacgcgcctggaa

SEQ ID NO: 4954 - DNA, 17 bp, Artificial sequence
  Synthesized sequence
ggggcggggcactcgct

SEQ ID NO: 4955 - DNA, 17 bp, Artificial sequence
  Synthesized sequence
tccgcacttctattgcc

SEQ ID NO: 4956 - DNA, 17 bp, Artificial sequence
  Synthesized sequence
ttggccaggcatgcgca

SEQ ID NO: 4957 - DNA, 17 bp, Artificial sequence
  Synthesized sequence
atggcacgcacggtagt

SEQ ID NO: 4958 - DNA, 17 bp, Artificial sequence
  Synthesized sequence
agggcaagaccgtggcc

SEQ ID NO: 4959 - DNA, 17 bp, Artificial sequence
  Synthesized sequence
ctggaatcgatcttccc

SEQ ID NO: 4960 - DNA, 17 bp, Artificial sequence
  Synthesized sequence
ttggcaggcatttaacg

SEQ ID NO: 4961 - DNA, 17 bp, Artificial sequence
  Synthesized sequence
atggccctggcccagct

SEQ ID NO: 4962 - DNA, 17 bp, Artificial sequence
  Synthesized sequence
ctggccctccccatgtt

SEQ ID NO: 4963 - DNA, 17 bp, Artificial sequence
  Synthesized sequence
ctgggcagcgtgctgct

SEQ ID NO: 4964 - DNA, 17 bp, Artificial sequence
  Synthesized sequence
ctggccagcggctggcc

SEQ ID NO: 4965 - DNA, 17 bp, Artificial sequence
  Synthesized sequence
cgggcgcgggatgtgcc

SEQ ID NO: 4966 - DNA, 17 bp, Artificial sequence
  Synthesized sequence
ctggtagccgtgttcct

SEQ ID NO: 4967 - DNA, 17 bp, Artificial sequence
  Synthesized sequence
ggggcgcgtcggtggca

SEQ ID NO: 4968 - DNA, 17 bp, Artificial sequence
  Synthesized sequence
ctggcacctgcagcgcc

SEQ ID NO: 4969 - DNA, 17 bp, Artificial sequence
  Synthesized sequence
acggcacggcctgcgcc

SEQ ID NO: 4970 - DNA, 17 bp, Artificial sequence
  Synthesized sequence
ctggaaaccctgctgcc

SEQ ID NO: 4971 - DNA, 17 bp, Artificial sequence
  Synthesized sequence
cgggcaggctgctggcg

SEQ ID NO: 4972 - DNA, 17 bp, Artificial sequence
  Synthesized sequence
ctggtaccgacagggca

SEQ ID NO: 4973 - DNA, 17 bp, Artificial sequence
  Synthesized sequence
gtggttcgtcgcctgcc

SEQ ID NO: 4974 - DNA, 17 bp, Artificial sequence
  Synthesized sequence
atcgcgcacaacgtgca

SEQ ID NO: 4975 - DNA, 17 bp, Artificial sequence
  Synthesized sequence
aaggcccgtgacttcca

SEQ ID NO: 4976 - DNA, 17 bp, Artificial sequence
  Synthesized sequence
ctggcgccgcctgggca

SEQ ID NO: 4977 - DNA, 17 bp, Artificial sequence
  Synthesized sequence
ctggccctggccgtgtt

SEQ ID NO: 4978 - DNA, 17 bp, Artificial sequence
  Synthesized sequence
gcggaacgcttggtgcc

SEQ ID NO: 4979 - DNA, 17 bp, Artificial sequence
  Synthesized sequence
tcggcagggtcttttcg

SEQ ID NO: 4980 - DNA, 17 bp, Artificial sequence
  Synthesized sequence
atgatatggatcttgtt

SEQ ID NO: 4981 - DNA, 17 bp, Artificial sequence
  Synthesized sequence
gaggcccgggtcttccc

SEQ ID NO: 4982 - DNA, 17 bp, Artificial sequence
  Synthesized sequence
gcgggactgggcctgct

SEQ ID NO: 4983 - DNA, 17 bp, Artificial sequence
  Synthesized sequence
gtggccgcctgcttcct

SEQ ID NO: 4984 - DNA, 17 bp, Artificial sequence
  Synthesized sequence
ctggcccaggcgatcct

SEQ ID NO: 4985 - DNA, 17 bp, Artificial sequence
  Synthesized sequence
ctgggccagcgcctgcc

SEQ ID NO: 4986 - DNA, 17 bp, Artificial sequence
  Synthesized sequence
caggcccagcgtttcca

SEQ ID NO: 4987 - DNA, 17 bp, Artificial sequence
  Synthesized sequence
ctgggactgaccgggca

SEQ ID NO: 4988 - DNA, 17 bp, Artificial sequence
  Synthesized sequence
ttgctacagggtgtgca

SEQ ID NO: 4989 - DNA, 17 bp, Artificial sequence
  Synthesized sequence
gtggctcgctggtggaa

SEQ ID NO: 4990 - DNA, 17 bp, Artificial sequence
  Synthesized sequence
atcgcacacctgctgga

SEQ ID NO: 4991 - DNA, 17 bp, Artificial sequence
  Synthesized sequence
acggcaagccgctggcc

SEQ ID NO: 4992 - DNA, 17 bp, Artificial sequence
  Synthesized sequence
ctgccacctgcttttct

SEQ ID NO: 4993 - DNA, 17 bp, Artificial sequence
  Synthesized sequence
atcggccagtcgttgct

SEQ ID NO: 4994 - DNA, 17 bp, Artificial sequence
  Synthesized sequence
gtgacgcggttgctgcc

SEQ ID NO: 4995 - DNA, 17 bp, Artificial sequence
  Synthesized sequence
cagggcaggcagttgct

SEQ ID NO: 4996 - DNA, 17 bp, Artificial sequence
  Synthesized sequence
cgtgcattcattttgca

SEQ ID NO: 4997 - DNA, 17 bp, Artificial sequence
  Synthesized sequence
cgtgcattcattttgca

SEQ ID NO: 4998 - DNA, 17 bp, Artificial sequence
  Synthesized sequence
caggcgctcttgctgct

SEQ ID NO: 4999 - DNA, 17 bp, Artificial sequence
  Synthesized sequence
atggaaagcctgctgtt

SEQ ID NO: 5000 - DNA, 17 bp, Artificial sequence
  Synthesized sequence
ctggcattgacgtggta

SEQ ID NO: 5001 - DNA, 17 bp, Artificial sequence
  Synthesized sequence
tcggcgcggccctggcc

SEQ ID NO: 5002 - DNA, 17 bp, Artificial sequence
  Synthesized sequence
ggtgcgcaggtattgct

SEQ ID NO: 5003 - DNA, 17 bp, Artificial sequence
  Synthesized sequence
gtcgcccgccgcctgcg

SEQ ID NO: 5004 - DNA, 17 bp, Artificial sequence
  Synthesized sequence
gttgcgcaccgcgtgca

SEQ ID NO: 5005 - DNA, 17 bp, Artificial sequence
  Synthesized sequence
ctgccacccgtctggcc

SEQ ID NO: 5006 - DNA, 17 bp, Artificial sequence
  Synthesized sequence
atggcaggcgcactgag

SEQ ID NO: 5007 - DNA, 17 bp, Artificial sequence
  Synthesized sequence
atggcaggcgcactgag

SEQ ID NO: 5008 - DNA, 17 bp, Artificial sequence
  Synthesized sequence
agagcatcggcgttgct

SEQ ID NO: 5009 - DNA, 17 bp, Artificial sequence
  Synthesized sequence
gtcggataggccttgcg

SEQ ID NO: 5010 - DNA, 17 bp, Artificial sequence
  Synthesized sequence
gtggcgctgatgtcgat

SEQ ID NO: 5011 - DNA, 17 bp, Artificial sequence
  Synthesized sequence
ctggcgaagcggtggcg

SEQ ID NO: 5012 - DNA, 17 bp, Artificial sequence
  Synthesized sequence
gtgccatttaccctgct

SEQ ID NO: 5013 - DNA, 17 bp, Artificial sequence
  Synthesized sequence
cttgcacggcacgggcg

SEQ ID NO: 5014 - DNA, 17 bp, Artificial sequence
  Synthesized sequence
tgggcgccgccggtgca

SEQ ID NO: 5015 - DNA, 17 bp, Artificial sequence
  Synthesized sequence
ctggcgcagcgcccgcg

SEQ ID NO: 5016 - DNA, 17 bp, Artificial sequence
  Synthesized sequence
gtgtaaagcatgttgcc

SEQ ID NO: 5017 - DNA, 17 bp, Artificial sequence
  Synthesized sequence
caagcgcaggtgttgca

SEQ ID NO: 5018 - DNA, 17 bp, Artificial sequence
  Synthesized sequence
ctggcgctgcgcctgga

SEQ ID NO: 5019 - DNA, 17 bp, Artificial sequence
  Synthesized sequence
gtggccagggcgttggc

SEQ ID NO: 5020 - DNA, 17 bp, Artificial sequence
  Synthesized sequence
gcggcacgttgtctgat

SEQ ID NO: 5021 - DNA, 17 bp, Artificial sequence
  Synthesized sequence
gaagcacggaatttgaa

SEQ ID NO: 5022 - DNA, 17 bp, Artificial sequence
  Synthesized sequence
ctggaacgacgcctggc

SEQ ID NO: 5023 - DNA, 17 bp, Artificial sequence
  Synthesized sequence
acggcatgctggtggcc

SEQ ID NO: 5024 - DNA, 17 bp, Artificial sequence
  Synthesized sequence
atggaagaacgctggcc

SEQ ID NO: 5025 - DNA, 17 bp, Artificial sequence
  Synthesized sequence
ctggccggacatccgct

SEQ ID NO: 5026 - DNA, 17 bp, Artificial sequence
  Synthesized sequence
gcggcaaacccgctgcg

SEQ ID NO: 5027 - DNA, 17 bp, Artificial sequence
  Synthesized sequence
ctgcaatgcctgctgct

SEQ ID NO: 5028 - DNA, 17 bp, Artificial sequence
  Synthesized sequence
ccggaacaacgcttcca

SEQ ID NO: 5029 - DNA, 17 bp, Artificial sequence
  Synthesized sequence
gtggaacgggccgggcg

SEQ ID NO: 5030 - DNA, 17 bp, Artificial sequence
  Synthesized sequence
cgggcaagccgttcgcc

SEQ ID NO: 5031 - DNA, 17 bp, Artificial sequence
  Synthesized sequence
cgggcacctgtgtggcc

SEQ ID NO: 5032 - DNA, 17 bp, Artificial sequence
  Synthesized sequence
gtggtgtacttctcgct

SEQ ID NO: 5033 - DNA, 17 bp, Artificial sequence
  Synthesized sequence
ttggcgcccctccttca

SEQ ID NO: 5034 - DNA, 17 bp, Artificial sequence
  Synthesized sequence
atgccacgcgacctgaa

SEQ ID NO: 5035 - DNA, 17 bp, Artificial sequence
  Synthesized sequence
ttgcgccaggcgttgct

SEQ ID NO: 5036 - DNA, 17 bp, Artificial sequence
  Synthesized sequence
gcggcaccgccaaggct

SEQ ID NO: 5037 - DNA, 17 bp, Artificial sequence
  Synthesized sequence
atgacagagccgttaca

SEQ ID NO: 5038 - DNA, 17 bp, Artificial sequence
  Synthesized sequence
gtggaaccgcctgtgga

SEQ ID NO: 5039 - DNA, 17 bp, Artificial sequence
  Synthesized sequence
ctgccgcaccaggtgct

SEQ ID NO: 5040 - DNA, 17 bp, Artificial sequence
  Synthesized sequence
ggggcagtgacatcgca

SEQ ID NO: 5041 - DNA, 17 bp, Artificial sequence
  Synthesized sequence
ctggccggacgccggct

SEQ ID NO: 5042 - DNA, 17 bp, Artificial sequence
  Synthesized sequence
gtggcgccgtccctcct

SEQ ID NO: 5043 - DNA, 17 bp, Artificial sequence
  Synthesized sequence
gtggcgtggttgatgta

SEQ ID NO: 5044 - DNA, 17 bp, Artificial sequence
  Synthesized sequence
ctgggaaggttccggca

SEQ ID NO: 5045 - DNA, 17 bp, Artificial sequence
  Synthesized sequence
caggcgctcgacctgct

SEQ ID NO: 5046 - DNA, 17 bp, Artificial sequence
  Synthesized sequence
ctggaacactgcgagca

SEQ ID NO: 5047 - DNA, 17 bp, Artificial sequence
  Synthesized sequence
ctgacccgtgccctgca

SEQ ID NO: 5048 - DNA, 17 bp, Artificial sequence
  Synthesized sequence
ctggcgctgaacctgga

SEQ ID NO: 5049 - DNA, 17 bp, Artificial sequence
  Synthesized sequence
ttggtgcggatcctggt

SEQ ID NO: 5050 - DNA, 17 bp, Artificial sequence
  Synthesized sequence
gtggcgcgcctgatccg

SEQ ID NO: 5051 - DNA, 17 bp, Artificial sequence
  Synthesized sequence
ttggctcgcgcatgcct

SEQ ID NO: 5052 - DNA, 17 bp, Artificial sequence
  Synthesized sequence
ctggaacagcaccagcc

SEQ ID NO: 5053 - DNA, 17 bp, Artificial sequence
  Synthesized sequence
gtggctcgtcacttcaa

SEQ ID NO: 5054 - DNA, 17 bp, Artificial sequence
  Synthesized sequence
atggacccatggctgct

SEQ ID NO: 5055 - DNA, 17 bp, Artificial sequence
  Synthesized sequence
ctggcgcacaagctgga

SEQ ID NO: 5056 - DNA, 17 bp, Artificial sequence
  Synthesized sequence
ccagcgcagcaattgca

SEQ ID NO: 5057 - DNA, 17 bp, Artificial sequence
  Synthesized sequence
ctggcgcgggccgggcc

SEQ ID NO: 5058 - DNA, 17 bp, Artificial sequence
  Synthesized sequence
ctggcccaggcgatcct

SEQ ID NO: 5059 - DNA, 17 bp, Artificial sequence
  Synthesized sequence
gcgggacagggggtgca

SEQ ID NO: 5060 - DNA, 17 bp, Artificial sequence
  Synthesized sequence
ctggaactggtgctgga

SEQ ID NO: 5061 - DNA, 17 bp, Artificial sequence
  Synthesized sequence
aaggcgccgacctggct

SEQ ID NO: 5062 - DNA, 17 bp, Artificial sequence
  Synthesized sequence
aaggcactgttcgtggt

SEQ ID NO: 5063 - DNA, 17 bp, Artificial sequence
  Synthesized sequence
gtggtgctctcggtgct

SEQ ID NO: 5064 - DNA, 17 bp, Artificial sequence
  Synthesized sequence
atggagcagagcgtgcg

SEQ ID NO: 5065 - DNA, 17 bp, Artificial sequence
  Synthesized sequence
ctgccgggtttcttgcc

SEQ ID NO: 5066 - DNA, 17 bp, Artificial sequence
  Synthesized sequence
ctggcgctggtggtgat

SEQ ID NO: 5067 - DNA, 17 bp, Artificial sequence
  Synthesized sequence
ctggtaacgctttcgcc

SEQ ID NO: 5068 - DNA, 17 bp, Artificial sequence
  Synthesized sequence
ctggcttgtccgtttcg

SEQ ID NO: 5069 - DNA, 17 bp, Artificial sequence
  Synthesized sequence
atcgcccacgccatgct

SEQ ID NO: 5070 - DNA, 17 bp, Artificial sequence
  Synthesized sequence
cggccaggaaacttgcg

SEQ ID NO: 5071 - DNA, 17 bp, Artificial sequence
  Synthesized sequence
ctggagccgtcggtgca

SEQ ID NO: 5072 - DNA, 17 bp, Artificial sequence
  Synthesized sequence
acggcaccgagcaggct

SEQ ID NO: 5073 - DNA, 17 bp, Artificial sequence
  Synthesized sequence
atggcgctgcaaccgca

SEQ ID NO: 5074 - DNA, 17 bp, Artificial sequence
  Synthesized sequence
ctggagcgcgcgctgcg

SEQ ID NO: 5075 - DNA, 17 bp, Artificial sequence
  Synthesized sequence
ctggcaggagtttctcg

SEQ ID NO: 5076 - DNA, 17 bp, Artificial sequence
  Synthesized sequence
ctggcgttcagcctgcg

SEQ ID NO: 5077 - DNA, 17 bp, Artificial sequence
  Synthesized sequence
ctggcggtcggctggct

SEQ ID NO: 5078 - DNA, 17 bp, Artificial sequence
  Synthesized sequence
ctggtgcccgggctgct

SEQ ID NO: 5079 - DNA, 17 bp, Artificial sequence
  Synthesized sequence
gggtgacgccgattgca

SEQ ID NO: 5080 - DNA, 17 bp, Artificial sequence
  Synthesized sequence
gcggcccggcgcttgtc

SEQ ID NO: 5081 - DNA, 17 bp, Artificial sequence
  Synthesized sequence
gcggcaacggcctcgca

SEQ ID NO: 5082 - DNA, 17 bp, Artificial sequence
  Synthesized sequence
atggctcgaatgaagcg

SEQ ID NO: 5083 - DNA, 17 bp, Artificial sequence
  Synthesized sequence
caggcaggccgttggcg

SEQ ID NO: 5084 - DNA, 17 bp, Artificial sequence
  Synthesized sequence
cgggcgaagcggttgcg

SEQ ID NO: 5085 - DNA, 17 bp, Artificial sequence
  Synthesized sequence
gcggcgcatcattcgct

SEQ ID NO: 5086 - DNA, 17 bp, Artificial sequence
  Synthesized sequence
caggcaagacggtcgcc

SEQ ID NO: 5087 - DNA, 17 bp, Artificial sequence
  Synthesized sequence
aagtcacatggcttgcg

SEQ ID NO: 5088 - DNA, 17 bp, Artificial sequence
  Synthesized sequence
atggcggcgatgatgcc

SEQ ID NO: 5089 - DNA, 17 bp, Artificial sequence
  Synthesized sequence
gtggctgattgttagct

SEQ ID NO: 5090 - DNA, 17 bp, Artificial sequence
  Synthesized sequence
ttcgcccgcatcctgcc

SEQ ID NO: 5091 - DNA, 17 bp, Artificial sequence
  Synthesized sequence
agggcgcggcgctggcg

SEQ ID NO: 5092 - DNA, 17 bp, Artificial sequence
  Synthesized sequence
ctggagccggcctggct

SEQ ID NO: 5093 - DNA, 17 bp, Artificial sequence
  Synthesized sequence
gtggcacaacgtgcgga

SEQ ID NO: 5094 - DNA, 17 bp, Artificial sequence
  Synthesized sequence
gtggccgccgggctgca

SEQ ID NO: 5095 - DNA, 17 bp, Artificial sequence
  Synthesized sequence
ctggcaggcgctcagcg

SEQ ID NO: 5096 - DNA, 17 bp, Artificial sequence
  Synthesized sequence
acggcgcggccttcgcc

SEQ ID NO: 5097 - DNA, 17 bp, Artificial sequence
  Synthesized sequence
gtgggccgccgctggcc

SEQ ID NO: 5098 - DNA, 17 bp, Artificial sequence
  Synthesized sequence
gcggcggccgcgttgct

SEQ ID NO: 5099 - DNA, 17 bp, Artificial sequence
  Synthesized sequence
gaggcgctggcgctgct

SEQ ID NO: 5100 - DNA, 17 bp, Artificial sequence
  Synthesized sequence
ctggagcaacgcctgcc

SEQ ID NO: 5101 - DNA, 17 bp, Artificial sequence
  Synthesized sequence
tcggcgcggcgctggcc

SEQ ID NO: 5102 - DNA, 17 bp, Artificial sequence
  Synthesized sequence
ccggcaccgcaccggca

SEQ ID NO: 5103 - DNA, 17 bp, Artificial sequence
  Synthesized sequence
ccggcaacatcgatgca

SEQ ID NO: 5104 - DNA, 17 bp, Artificial sequence
  Synthesized sequence
agggcgccaaaggtgct

SEQ ID NO: 5105 - DNA, 17 bp, Artificial sequence
  Synthesized sequence
ccggcgagcgtcgtgct

SEQ ID NO: 5106 - DNA, 17 bp, Artificial sequence
  Synthesized sequence
atgggtccgggcctgca

SEQ ID NO: 5107 - DNA, 17 bp, Artificial sequence
  Synthesized sequence
ttgaaatggctcttggt

SEQ ID NO: 5108 - DNA, 17 bp, Artificial sequence
  Synthesized sequence
gtcggcctgattttgct

SEQ ID NO: 5109 - DNA, 17 bp, Artificial sequence
  Synthesized sequence
atgagaagccagttgcg

SEQ ID NO: 5110 - DNA, 17 bp, Artificial sequence
  Synthesized sequence
gaggcaagaagatcgcc

SEQ ID NO: 5111 - DNA, 17 bp, Artificial sequence
  Synthesized sequence
ttcgccagagccttgcg

SEQ ID NO: 5112 - DNA, 17 bp, Artificial sequence
  Synthesized sequence
ctggcgcacgcggcgct

SEQ ID NO: 5113 - DNA, 17 bp, Artificial sequence
  Synthesized sequence
ctgccgctgtacctgct

SEQ ID NO: 5114 - DNA, 17 bp, Artificial sequence
  Synthesized sequence
gggaaacaggtattgca

SEQ ID NO: 5115 - DNA, 17 bp, Artificial sequence
  Synthesized sequence
ctggcgcaatgggcgca

SEQ ID NO: 5116 - DNA, 17 bp, Artificial sequence
  Synthesized sequence
ctggcataatcgccgcc

SEQ ID NO: 5117 - DNA, 17 bp, Artificial sequence
  Synthesized sequence
caggcttgactctttca

SEQ ID NO: 5118 - DNA, 17 bp, Artificial sequence
  Synthesized sequence
ccggcacggcctgggcc

SEQ ID NO: 5119 - DNA, 17 bp, Artificial sequence
  Synthesized sequence
gtggagcagacgctgcg

SEQ ID NO: 5120 - DNA, 17 bp, Artificial sequence
  Synthesized sequence
ctgccggaggcgttgca

SEQ ID NO: 5121 - DNA, 17 bp, Artificial sequence
  Synthesized sequence
gtggcgccggaccagca

SEQ ID NO: 5122 - DNA, 17 bp, Artificial sequence
  Synthesized sequence
gtgcaacggggcttcca

SEQ ID NO: 5123 - DNA, 17 bp, Artificial sequence
  Synthesized sequence
tcggcacggatctcgtg

SEQ ID NO: 5124 - DNA, 17 bp, Artificial sequence
  Synthesized sequence
ctagcattccgctcgca

SEQ ID NO: 5125 - DNA, 17 bp, Artificial sequence
  Synthesized sequence
gttgcagggcgctggcg

SEQ ID NO: 5126 - DNA, 17 bp, Artificial sequence
  Synthesized sequence
atcgcccgcggctttct

SEQ ID NO: 5127 - DNA, 17 bp, Artificial sequence
  Synthesized sequence
ctggcgcaacgtctcca

SEQ ID NO: 5128 - DNA, 17 bp, Artificial sequence
  Synthesized sequence
tgcgcacaggtgatgct

SEQ ID NO: 5129 - DNA, 17 bp, Artificial sequence
  Synthesized sequence
atggcggcggtcatgcg

SEQ ID NO: 5130 - DNA, 17 bp, Artificial sequence
  Synthesized sequence
agcgctcgcgaattgct

SEQ ID NO: 5131 - DNA, 17 bp, Artificial sequence
  Synthesized sequence
caggcgctcaacgtgca

SEQ ID NO: 5132 - DNA, 17 bp, Artificial sequence
  Synthesized sequence
gagcgaccgctgttgct

SEQ ID NO: 5133 - DNA, 17 bp, Artificial sequence
  Synthesized sequence
gtggcgcgttcctgtct

SEQ ID NO: 5134 - DNA, 17 bp, Artificial sequence
  Synthesized sequence
ccggcacgcgtgtagta

SEQ ID NO: 5135 - DNA, 17 bp, Artificial sequence
  Synthesized sequence
ctgccggcccagttgct

SEQ ID NO: 5136 - DNA, 17 bp, Artificial sequence
  Synthesized sequence
tcggcccgaccctggcc

SEQ ID NO: 5137 - DNA, 17 bp, Artificial sequence
  Synthesized sequence
ctggcgcgtctgttcga

SEQ ID NO: 5138 - DNA, 17 bp, Artificial sequence
  Synthesized sequence
ctggcacaggcggcgtt

SEQ ID NO: 5139 - DNA, 17 bp, Artificial sequence
  Synthesized sequence
ctggcacaggcggcgtt

SEQ ID NO: 5140 - DNA, 17 bp, Artificial sequence
  Synthesized sequence
caggcgctctacgtgct

SEQ ID NO: 5141 - DNA, 17 bp, Artificial sequence
  Synthesized sequence
ctggcatgggtcgagtt

SEQ ID NO: 5142 - DNA, 17 bp, Artificial sequence
  Synthesized sequence
tcggcgcggactatgcc

SEQ ID NO: 5143 - DNA, 17 bp, Artificial sequence
  Synthesized sequence
atggtctcctcgttgcg

SEQ ID NO: 5144 - DNA, 17 bp, Artificial sequence
  Synthesized sequence
gtgacctggaccctgct

SEQ ID NO: 5145 - DNA, 17 bp, Artificial sequence
  Synthesized sequence
gcggcaaggtggtcgcc

SEQ ID NO: 5146 - DNA, 17 bp, Artificial sequence
  Synthesized sequence
ccggccatcacgttgca

SEQ ID NO: 5147 - DNA, 17 bp, Artificial sequence
  Synthesized sequence
cttgcccacggcgtgct

SEQ ID NO: 5148 - DNA, 17 bp, Artificial sequence
  Synthesized sequence
ctggtccaggtctggcg

SEQ ID NO: 5149 - DNA, 17 bp, Artificial sequence
  Synthesized sequence
ttggaaccccacgagca

SEQ ID NO: 5150 - DNA, 17 bp, Artificial sequence
  Synthesized sequence
ctcgaacggctgtggcg

SEQ ID NO: 5151 - DNA, 17 bp, Artificial sequence
  Synthesized sequence
acggcctcgccgttgcg

SEQ ID NO: 5152 - DNA, 17 bp, Artificial sequence
  Synthesized sequence
ttgccagggcgctggcg

SEQ ID NO: 5153 - DNA, 17 bp, Artificial sequence
  Synthesized sequence
ttggccggagcgtcgcc

SEQ ID NO: 5154 - DNA, 17 bp, Artificial sequence
  Synthesized sequence
ctggcgcaccaggtgga

SEQ ID NO: 5155 - DNA, 17 bp, Artificial sequence
  Synthesized sequence
acggcatcacccgtgcc

SEQ ID NO: 5156 - DNA, 17 bp, Artificial sequence
  Synthesized sequence
attgcccgccgcctgcg

SEQ ID NO: 5157 - DNA, 17 bp, Artificial sequence
  Synthesized sequence
gccgcgcgctggttgct

SEQ ID NO: 5158 - DNA, 17 bp, Artificial sequence
  Synthesized sequence
acgccacggaagttgaa

SEQ ID NO: 5159 - DNA, 17 bp, Artificial sequence
  Synthesized sequence
atggccttggccctgcc

SEQ ID NO: 5160 - DNA, 17 bp, Artificial sequence
  Synthesized sequence
ggggcacgagttccgcc

SEQ ID NO: 5161 - DNA, 17 bp, Artificial sequence
  Synthesized sequence
gtggcgagatcgtagcc

SEQ ID NO: 5162 - DNA, 17 bp, Artificial sequence
  Synthesized sequence
ctcgccgagcccttgcg

SEQ ID NO: 5163 - DNA, 17 bp, Artificial sequence
  Synthesized sequence
gtggtgcgcgcggtgcc

SEQ ID NO: 5164 - DNA, 17 bp, Artificial sequence
  Synthesized sequence
atggcagccgccacgca

SEQ ID NO: 5165 - DNA, 17 bp, Artificial sequence
  Synthesized sequence
ttggggagactcttgtt

SEQ ID NO: 5166 - DNA, 17 bp, Artificial sequence
  Synthesized sequence
ctggaatggggcgagct

SEQ ID NO: 5167 - DNA, 17 bp, Artificial sequence
  Synthesized sequence
ctggcgccgcggcggct

SEQ ID NO: 5168 - DNA, 17 bp, Artificial sequence
  Synthesized sequence
ctgccgctgatggtgct

SEQ ID NO: 5169 - DNA, 17 bp, Artificial sequence
  Synthesized sequence
ttgccaatgatattgat

SEQ ID NO: 5170 - DNA, 17 bp, Artificial sequence
  Synthesized sequence
ctggcgcaagctgcgca

SEQ ID NO: 5171 - DNA, 17 bp, Artificial sequence
  Synthesized sequence
aaggcacctcaatagcc

SEQ ID NO: 5172 - DNA, 17 bp, Artificial sequence
  Synthesized sequence
ctgccgctgctctggct

SEQ ID NO: 5173 - DNA, 17 bp, Artificial sequence
  Synthesized sequence
aagacatgggatttgcc

SEQ ID NO: 5174 - DNA, 17 bp, Artificial sequence
  Synthesized sequence
ccggcactcttcgcgct

SEQ ID NO: 5175 - DNA, 17 bp, Artificial sequence
  Synthesized sequence
agggcacgttgagggct

SEQ ID NO: 5176 - DNA, 17 bp, Artificial sequence
  Synthesized sequence
gtggggcggaagtagcg

SEQ ID NO: 5177 - DNA, 17 bp, Artificial sequence
  Synthesized sequence
acggcgctgttgtagct

SEQ ID NO: 5178 - DNA, 17 bp, Artificial sequence
  Synthesized sequence
tgggcagaacccatgcc

SEQ ID NO: 5179 - DNA, 17 bp, Artificial sequence
  Synthesized sequence
gtgggcggcaacctgca

SEQ ID NO: 5180 - DNA, 17 bp, Artificial sequence
  Synthesized sequence
ctggcgttgtggctgcg

SEQ ID NO: 5181 - DNA, 17 bp, Artificial sequence
  Synthesized sequence
ctggcaacatcctggtt

SEQ ID NO: 5182 - DNA, 17 bp, Artificial sequence
  Synthesized sequence
gaggcgctggcgctgct

SEQ ID NO: 5183 - DNA, 17 bp, Artificial sequence
  Synthesized sequence
cgggcaggcccctttcc

SEQ ID NO: 5184 - DNA, 17 bp, Artificial sequence
  Synthesized sequence
gcggcaggtgcgtttca

SEQ ID NO: 5185 - DNA, 17 bp, Artificial sequence
  Synthesized sequence
atcgaagcggagttgct

SEQ ID NO: 5186 - DNA, 17 bp, Artificial sequence
  Synthesized sequence
atcgaacgcttcctgcc

SEQ ID NO: 5187 - DNA, 17 bp, Artificial sequence
  Synthesized sequence
ctggcaggtggatcgga

SEQ ID NO: 5188 - DNA, 17 bp, Artificial sequence
  Synthesized sequence
gtgggcctggcactgct

SEQ ID NO: 5189 - DNA, 17 bp, Artificial sequence
  Synthesized sequence
tcggcgcggtgctcgcg

SEQ ID NO: 5190 - DNA, 17 bp, Artificial sequence
  Synthesized sequence
ccggcggcctggttgct

SEQ ID NO: 5191 - DNA, 17 bp, Artificial sequence
  Synthesized sequence
ctggccggcccatttcg

SEQ ID NO: 5192 - DNA, 17 bp, Artificial sequence
  Synthesized sequence
aaggcatttttttggca

SEQ ID NO: 5193 - DNA, 17 bp, Artificial sequence
  Synthesized sequence
ctggccgacgccctgcg

SEQ ID NO: 5194 - DNA, 17 bp, Artificial sequence
  Synthesized sequence
ctggctgggataccgct

SEQ ID NO: 5195 - DNA, 17 bp, Artificial sequence
  Synthesized sequence
tgggcatgctgatcgcc

SEQ ID NO: 5196 - DNA, 17 bp, Artificial sequence
  Synthesized sequence
agggcgcgaccctggcc

SEQ ID NO: 5197 - DNA, 17 bp, Artificial sequence
  Synthesized sequence
atggtccagactgtgcg

SEQ ID NO: 5198 - DNA, 17 bp, Artificial sequence
  Synthesized sequence
gtggtgccgatcctgcg

SEQ ID NO: 5199 - DNA, 17 bp, Artificial sequence
  Synthesized sequence
ctggcctggcggctggt

SEQ ID NO: 5200 - DNA, 17 bp, Artificial sequence
  Synthesized sequence
gcggcgcacggctcgct

SEQ ID NO: 5201 - DNA, 17 bp, Artificial sequence
  Synthesized sequence
atcgcccaccgctggct

SEQ ID NO: 5202 - DNA, 17 bp, Artificial sequence
  Synthesized sequence
ttggtctagtatctgct

SEQ ID NO: 5203 - DNA, 17 bp, Artificial sequence
  Synthesized sequence
gaggcgctcaagctgct

SEQ ID NO: 5204 - DNA, 17 bp, Artificial sequence
  Synthesized sequence
ctggcagatcgaataca

SEQ ID NO: 5205 - DNA, 17 bp, Artificial sequence
  Synthesized sequence
ttggaatcggcgatgcg

SEQ ID NO: 5206 - DNA, 17 bp, Artificial sequence
  Synthesized sequence
gtggcgcgccatgcgcc

SEQ ID NO: 5207 - DNA, 17 bp, Artificial sequence
  Synthesized sequence
aagtcgcagccgttgct

SEQ ID NO: 5208 - DNA, 17 bp, Artificial sequence
  Synthesized sequence
acggccctggacatgca

SEQ ID NO: 5209 - DNA, 17 bp, Artificial sequence
  Synthesized sequence
atggcaccaccatgacc

SEQ ID NO: 5210 - DNA, 17 bp, Artificial sequence
  Synthesized sequence
ctggcatcgcccgtggc

SEQ ID NO: 5211 - DNA, 17 bp, Artificial sequence
  Synthesized sequence
ttggaagggcgcctggt

SEQ ID NO: 5212 - DNA, 17 bp, Artificial sequence
  Synthesized sequence
atggctagaaaattccg

SEQ ID NO: 5213 - DNA, 17 bp, Artificial sequence
  Synthesized sequence
acggcgagccttctgca

SEQ ID NO: 5214 - DNA, 17 bp, Artificial sequence
  Synthesized sequence
ctggcaggtacccggcc

SEQ ID NO: 5215 - DNA, 17 bp, Artificial sequence
  Synthesized sequence
ctggcgcgggtgctggc

SEQ ID NO: 5216 - DNA, 17 bp, Artificial sequence
  Synthesized sequence
ggggcgggcctgatgct

SEQ ID NO: 5217 - DNA, 17 bp, Artificial sequence
  Synthesized sequence
gtcgcgcgcgcgtagct

SEQ ID NO: 5218 - DNA, 17 bp, Artificial sequence
  Synthesized sequence
ttgaaacagcttttcca

SEQ ID NO: 5219 - DNA, 17 bp, Artificial sequence
  Synthesized sequence
ctggcggccctgatgcg

SEQ ID NO: 5220 - DNA, 17 bp, Artificial sequence
  Synthesized sequence
ctggctgctctgttgtt

SEQ ID NO: 5221 - DNA, 17 bp, Artificial sequence
  Synthesized sequence
gaggaacgcctgtagcc

SEQ ID NO: 5222 - DNA, 17 bp, Artificial sequence
  Synthesized sequence
ccgggacgccctgtgcg

SEQ ID NO: 5223 - DNA, 17 bp, Artificial sequence
  Synthesized sequence
ctggcgttgtcctcgcg

SEQ ID NO: 5224 - DNA, 17 bp, Artificial sequence
  Synthesized sequence
ctgctactgccactgct

SEQ ID NO: 5225 - DNA, 17 bp, Artificial sequence
  Synthesized sequence
gcggcgctacaggtgct

SEQ ID NO: 5226 - DNA, 17 bp, Artificial sequence
  Synthesized sequence
ctgggcctgccgttgtt

SEQ ID NO: 5227 - DNA, 17 bp, Artificial sequence
  Synthesized sequence
ctggcgcaagctgcgca

SEQ ID NO: 5228 - DNA, 17 bp, Artificial sequence
  Synthesized sequence
gcggcaagggcgtggcc

SEQ ID NO: 5229 - DNA, 17 bp, Artificial sequence
  Synthesized sequence
atggaactgaccctgaa

SEQ ID NO: 5230 - DNA, 17 bp, Artificial sequence
  Synthesized sequence
gtggcatggctgacgaa

SEQ ID NO: 5231 - DNA, 17 bp, Artificial sequence
  Synthesized sequence
atggccggggctttccg

SEQ ID NO: 5232 - DNA, 17 bp, Artificial sequence
  Synthesized sequence
gtggtcctggtgttcct

SEQ ID NO: 5233 - DNA, 17 bp, Artificial sequence
  Synthesized sequence
tcggcaccctgttcgcc

SEQ ID NO: 5234 - DNA, 17 bp, Artificial sequence
  Synthesized sequence
ttgtccagcgccttgcg

SEQ ID NO: 5235 - DNA, 17 bp, Artificial sequence
  Synthesized sequence
ctggccaaccaggtgcc

SEQ ID NO: 5236 - DNA, 17 bp, Artificial sequence
  Synthesized sequence
gttgcaggtccgttgaa

SEQ ID NO: 5237 - DNA, 17 bp, Artificial sequence
  Synthesized sequence
atggcacaaattcgcca

SEQ ID NO: 5238 - DNA, 17 bp, Artificial sequence
  Synthesized sequence
gtcgcgctgcatgtgct

SEQ ID NO: 5239 - DNA, 17 bp, Artificial sequence
  Synthesized sequence
ttggtgcaccacatgcc

SEQ ID NO: 5240 - DNA, 17 bp, Artificial sequence
  Synthesized sequence
ctggccagcctggcgct

SEQ ID NO: 5241 - DNA, 17 bp, Artificial sequence
  Synthesized sequence
attccgcgcaccttgct

SEQ ID NO: 5242 - DNA, 17 bp, Artificial sequence
  Synthesized sequence
atggcacctggatatca

SEQ ID NO: 5243 - DNA, 17 bp, Artificial sequence
  Synthesized sequence
gcggcactgatctcgtt

SEQ ID NO: 5244 - DNA, 17 bp, Artificial sequence
  Synthesized sequence
ctggacctcgatctgct

SEQ ID NO: 5245 - DNA, 17 bp, Artificial sequence
  Synthesized sequence
ctggacctcgatctgct

SEQ ID NO: 5246 - DNA, 17 bp, Artificial sequence
  Synthesized sequence
gtggtgcacatgctgcg

SEQ ID NO: 5247 - DNA, 17 bp, Artificial sequence
  Synthesized sequence
gtcgcgcaaccgtcgct

SEQ ID NO: 5248 - DNA, 17 bp, Artificial sequence
  Synthesized sequence
ctggaagggttggcgct

SEQ ID NO: 5249 - DNA, 17 bp, Artificial sequence
  Synthesized sequence
atggcgcgccgccagcc

SEQ ID NO: 5250 - DNA, 17 bp, Artificial sequence
  Synthesized sequence
gccgcgcagcagttgca

SEQ ID NO: 5251 - DNA, 17 bp, Artificial sequence
  Synthesized sequence
gcggccagcctgctgct

SEQ ID NO: 5252 - DNA, 17 bp, Artificial sequence
  Synthesized sequence
tgggccgagtccttgcg

SEQ ID NO: 5253 - DNA, 17 bp, Artificial sequence
  Synthesized sequence
ttcgcgcagggtgtgct

SEQ ID NO: 5254 - DNA, 17 bp, Artificial sequence
  Synthesized sequence
ctggcgcgacctgcgcc

SEQ ID NO: 5255 - DNA, 17 bp, Artificial sequence
  Synthesized sequence
cttgcgcagcacttcca

SEQ ID NO: 5256 - DNA, 17 bp, Artificial sequence
  Synthesized sequence
ttatcactaattttgcg

SEQ ID NO: 5257 - DNA, 17 bp, Artificial sequence
  Synthesized sequence
ctggccgacgctctgcg

SEQ ID NO: 5258 - DNA, 17 bp, Artificial sequence
  Synthesized sequence
ctggccatccgttttct

SEQ ID NO: 5259 - DNA, 17 bp, Artificial sequence
  Synthesized sequence
gtggccggcaagtggcc

SEQ ID NO: 5260 - DNA, 17 bp, Artificial sequence
  Synthesized sequence
gtggtggagaacctgct

SEQ ID NO: 5261 - DNA, 17 bp, Artificial sequence
  Synthesized sequence
ttcgccttctcgttgct

SEQ ID NO: 5262 - DNA, 17 bp, Artificial sequence
  Synthesized sequence
ttggccggctggtggcg

SEQ ID NO: 5263 - DNA, 17 bp, Artificial sequence
  Synthesized sequence
gcggcgggtgtattgcg

SEQ ID NO: 5264 - DNA, 17 bp, Artificial sequence
  Synthesized sequence
ggggccgggctctggca

SEQ ID NO: 5265 - DNA, 17 bp, Artificial sequence
  Synthesized sequence
ttggccagtccatcgcc

SEQ ID NO: 5266 - DNA, 17 bp, Artificial sequence
  Synthesized sequence
ctggctggacgtttccc

SEQ ID NO: 5267 - DNA, 17 bp, Artificial sequence
  Synthesized sequence
atggcgcggtgcgcgcc

SEQ ID NO: 5268 - DNA, 17 bp, Artificial sequence
  Synthesized sequence
gttgctcgaggagtgca

SEQ ID NO: 5269 - DNA, 17 bp, Artificial sequence
  Synthesized sequence
gttgctcgaggagtgca

SEQ ID NO: 5270 - DNA, 17 bp, Artificial sequence
  Synthesized sequence
ctggcggtctggctgca

SEQ ID NO: 5271 - DNA, 17 bp, Artificial sequence
  Synthesized sequence
ctggcgcgtcgctacca

SEQ ID NO: 5272 - DNA, 17 bp, Artificial sequence
  Synthesized sequence
cgcgcacggcacctgcc

SEQ ID NO: 5273 - DNA, 17 bp, Artificial sequence
  Synthesized sequence
ttggcgcgcaggtgaca

SEQ ID NO: 5274 - DNA, 17 bp, Artificial sequence
  Synthesized sequence
ccggcatggacccggct

SEQ ID NO: 5275 - DNA, 17 bp, Artificial sequence
  Synthesized sequence
ccggctcgcgccctgcg

SEQ ID NO: 5276 - DNA, 17 bp, Artificial sequence
  Synthesized sequence
atcggcctgctgttgca

SEQ ID NO: 5277 - DNA, 17 bp, Artificial sequence
  Synthesized sequence
gcggcaagactcgcgct

SEQ ID NO: 5278 - DNA, 17 bp, Artificial sequence
  Synthesized sequence
ccggcagggccattacc

SEQ ID NO: 5279 - DNA, 17 bp, Artificial sequence
  Synthesized sequence
ctggcgtcgcgcttgag

SEQ ID NO: 5280 - DNA, 17 bp, Artificial sequence
  Synthesized sequence
gtgggcggctacgtgct

SEQ ID NO: 5281 - DNA, 17 bp, Artificial sequence
  Synthesized sequence
ttggcggagggtctgcc

SEQ ID NO: 5282 - DNA, 17 bp, Artificial sequence
  Synthesized sequence
ctggcggcccttctgcc

SEQ ID NO: 5283 - DNA, 17 bp, Artificial sequence
  Synthesized sequence
cggccactacaattgcc

SEQ ID NO: 5284 - DNA, 17 bp, Artificial sequence
  Synthesized sequence
gtcgcgcactgcctgct

SEQ ID NO: 5285 - DNA, 17 bp, Artificial sequence
  Synthesized sequence
atgccacaggacccgca

SEQ ID NO: 5286 - DNA, 17 bp, Artificial sequence
  Synthesized sequence
gccgcacgctacttcct

SEQ ID NO: 5287 - DNA, 17 bp, Artificial sequence
  Synthesized sequence
ctggcgctgcgcatgga

SEQ ID NO: 5288 - DNA, 17 bp, Artificial sequence
  Synthesized sequence
atggcactcgagatgtc

SEQ ID NO: 5289 - DNA, 17 bp, Artificial sequence
  Synthesized sequence
ttgctgcggcagttgcc

SEQ ID NO: 5290 - DNA, 17 bp, Artificial sequence
  Synthesized sequence
ccggcaagaacatcgcc

SEQ ID NO: 5291 - DNA, 17 bp, Artificial sequence
  Synthesized sequence
ctcgtgcggaccttgcc

SEQ ID NO: 5292 - DNA, 17 bp, Artificial sequence
  Synthesized sequence
ctggccaaggactggcg

SEQ ID NO: 5293 - DNA, 17 bp, Artificial sequence
  Synthesized sequence
aaggcacgcttcatgac

SEQ ID NO: 5294 - DNA, 17 bp, Artificial sequence
  Synthesized sequence
ctggcagcgtgagagca

SEQ ID NO: 5295 - DNA, 17 bp, Artificial sequence
  Synthesized sequence
ctggagcgctggatgcg

SEQ ID NO: 5296 - DNA, 17 bp, Artificial sequence
  Synthesized sequence
gtgccgcacctgtcgca

SEQ ID NO: 5297 - DNA, 17 bp, Artificial sequence
  Synthesized sequence
atcggccgccttttgcg

SEQ ID NO: 5298 - DNA, 17 bp, Artificial sequence
  Synthesized sequence
ctggctcggccgctggc

SEQ ID NO: 5299 - DNA, 17 bp, Artificial sequence
  Synthesized sequence
gcgccacgcgcctggct

SEQ ID NO: 5300 - DNA, 17 bp, Artificial sequence
  Synthesized sequence
gcggcatgccccctggt

SEQ ID NO: 5301 - DNA, 17 bp, Artificial sequence
  Synthesized sequence
gtcgccagcagcttgcc

SEQ ID NO: 5302 - DNA, 17 bp, Artificial sequence
  Synthesized sequence
ctggcgccgcaggttct

SEQ ID NO: 5303 - DNA, 17 bp, Artificial sequence
  Synthesized sequence
ctgccctggtacctgct

SEQ ID NO: 5304 - DNA, 17 bp, Artificial sequence
  Synthesized sequence
caggcggggctgtcgct

SEQ ID NO: 5305 - DNA, 17 bp, Artificial sequence
  Synthesized sequence
ccggcacggcgcaagcg

SEQ ID NO: 5306 - DNA, 17 bp, Artificial sequence
  Synthesized sequence
atcgaatggccgctgct

SEQ ID NO: 5307 - DNA, 17 bp, Artificial sequence
  Synthesized sequence
gcggcccggccctggcc

SEQ ID NO: 5308 - DNA, 17 bp, Artificial sequence
  Synthesized sequence
gtgcgcctgcacttgct

SEQ ID NO: 5309 - DNA, 17 bp, Artificial sequence
  Synthesized sequence
atgggacgacggtaaca

SEQ ID NO: 5310 - DNA, 17 bp, Artificial sequence
  Synthesized sequence
ctggctggcctgccgct

SEQ ID NO: 5311 - DNA, 17 bp, Artificial sequence
  Synthesized sequence
ccggcagatcggtggca

SEQ ID NO: 5312 - DNA, 17 bp, Artificial sequence
  Synthesized sequence
ctgccgagccgcttgcg

SEQ ID NO: 5313 - DNA, 17 bp, Artificial sequence
  Synthesized sequence
ctggcattggagtggaa

SEQ ID NO: 5314 - DNA, 17 bp, Artificial sequence
  Synthesized sequence
cttccattgcagttgct

SEQ ID NO: 5315 - DNA, 17 bp, Artificial sequence
  Synthesized sequence
atggtacggggcctggg

SEQ ID NO: 5316 - DNA, 17 bp, Artificial sequence
  Synthesized sequence
atcgccgggctgatgct

SEQ ID NO: 5317 - DNA, 17 bp, Artificial sequence
  Synthesized sequence
caggcccatactgtgct

SEQ ID NO: 5318 - DNA, 17 bp, Artificial sequence
  Synthesized sequence
ctggcagggcgatgccg

SEQ ID NO: 5319 - DNA, 17 bp, Artificial sequence
  Synthesized sequence
gtgggcggcccgctgct

SEQ ID NO: 5320 - DNA, 17 bp, Artificial sequence
  Synthesized sequence
ccggcaccctggtggcg

SEQ ID NO: 5321 - DNA, 17 bp, Artificial sequence
  Synthesized sequence
gtggcgaagaagtggcg

SEQ ID NO: 5322 - DNA, 17 bp, Artificial sequence
  Synthesized sequence
gtggcacagccggggga

SEQ ID NO: 5323 - DNA, 17 bp, Artificial sequence
  Synthesized sequence
tttgcaagtccattgga

SEQ ID NO: 5324 - DNA, 17 bp, Artificial sequence
  Synthesized sequence
ctggcctgggtgatcct

SEQ ID NO: 5325 - DNA, 17 bp, Artificial sequence
  Synthesized sequence
gtggtcggcaccgtgct

SEQ ID NO: 5326 - DNA, 17 bp, Artificial sequence
  Synthesized sequence
ccggctgcaggcttgca

SEQ ID NO: 5327 - DNA, 17 bp, Artificial sequence
  Synthesized sequence
ttggtgcgagccttgtg

SEQ ID NO: 5328 - DNA, 17 bp, Artificial sequence
  Synthesized sequence
caggcacggcgcctggc

SEQ ID NO: 5329 - DNA, 17 bp, Artificial sequence
  Synthesized sequence
ctggcggaacaggtgcc

SEQ ID NO: 5330 - DNA, 17 bp, Artificial sequence
  Synthesized sequence
ctgcacctgcttttgca

SEQ ID NO: 5331 - DNA, 17 bp, Artificial sequence
  Synthesized sequence
ctcttacgctctttgct

SEQ ID NO: 5332 - DNA, 17 bp, Artificial sequence
  Synthesized sequence
ctgccaccacctttccg

SEQ ID NO: 5333 - DNA, 17 bp, Artificial sequence
  Synthesized sequence
gtggcccggacgctggc

SEQ ID NO: 5334 - DNA, 17 bp, Artificial sequence
  Synthesized sequence
atggcaccccgatcgtc

SEQ ID NO: 5335 - DNA, 17 bp, Artificial sequence
  Synthesized sequence
ggggcatcgctcttccg

SEQ ID NO: 5336 - DNA, 17 bp, Artificial sequence
  Synthesized sequence
atagcacagcgtccgca

SEQ ID NO: 5337 - DNA, 17 bp, Artificial sequence
  Synthesized sequence
atgggacgctcatccca

SEQ ID NO: 5338 - DNA, 17 bp, Artificial sequence
  Synthesized sequence
ctggcgtgggtgcagca

SEQ ID NO: 5339 - DNA, 17 bp, Artificial sequence
  Synthesized sequence
gcggcacggccactggg

SEQ ID NO: 5340 - DNA, 17 bp, Artificial sequence
  Synthesized sequence
ctggcgcactggccgca

SEQ ID NO: 5341 - DNA, 17 bp, Artificial sequence
  Synthesized sequence
ctggccgccttttttca

SEQ ID NO: 5342 - DNA, 17 bp, Artificial sequence
  Synthesized sequence
ctggccgccttttttca

SEQ ID NO: 5343 - DNA, 17 bp, Artificial sequence
  Synthesized sequence
ggggcgctgcgctggct

SEQ ID NO: 5344 - DNA, 17 bp, Artificial sequence
  Synthesized sequence
tgggccctgcgctcgct

SEQ ID NO: 5345 - DNA, 17 bp, Artificial sequence
  Synthesized sequence
ctggcagagctgatccg

SEQ ID NO: 5346 - DNA, 17 bp, Artificial sequence
  Synthesized sequence
ccggcaggcgttttggg

SEQ ID NO: 5347 - DNA, 17 bp, Artificial sequence
  Synthesized sequence
ctggaagcgaccatgcg

SEQ ID NO: 5348 - DNA, 17 bp, Artificial sequence
  Synthesized sequence
gaggcacatcgcgcgct

SEQ ID NO: 5349 - DNA, 17 bp, Artificial sequence
  Synthesized sequence
ctggaatgccacctgaa

SEQ ID NO: 5350 - DNA, 17 bp, Artificial sequence
  Synthesized sequence
gtggtcggcgacctgct

SEQ ID NO: 5351 - DNA, 17 bp, Artificial sequence
  Synthesized sequence
gcggccggcaacctgct

SEQ ID NO: 5352 - DNA, 17 bp, Artificial sequence
  Synthesized sequence
ttggcgtccaccatgcg

SEQ ID NO: 5353 - DNA, 17 bp, Artificial sequence
  Synthesized sequence
atcgcacccatcttccc

SEQ ID NO: 5354 - DNA, 17 bp, Artificial sequence
  Synthesized sequence
gtggaaaacggcgtgcg

SEQ ID NO: 5355 - DNA, 17 bp, Artificial sequence
  Synthesized sequence
ctggggcatggcctgca

SEQ ID NO: 5356 - DNA, 17 bp, Artificial sequence
  Synthesized sequence
gtggccctgaccctggt

SEQ ID NO: 5357 - DNA, 17 bp, Artificial sequence
  Synthesized sequence
ctagaagatccattgct

SEQ ID NO: 5358 - DNA, 17 bp, Artificial sequence
  Synthesized sequence
ctggctcgacgagcgcg

SEQ ID NO: 5359 - DNA, 17 bp, Artificial sequence
  Synthesized sequence
gtggctgactgtttgta

SEQ ID NO: 5360 - DNA, 17 bp, Artificial sequence
  Synthesized sequence
ctggaaccggtggagct

SEQ ID NO: 5361 - DNA, 17 bp, Artificial sequence
  Synthesized sequence
caggcaccgctgctgga

SEQ ID NO: 5362 - DNA, 17 bp, Artificial sequence
  Synthesized sequence
ttgacccggatgatgcc

SEQ ID NO: 5363 - DNA, 17 bp, Artificial sequence
  Synthesized sequence
atggcgctggatcggct

SEQ ID NO: 5364 - DNA, 17 bp, Artificial sequence
  Synthesized sequence
tgggcccagggttcgca

SEQ ID NO: 5365 - DNA, 17 bp, Artificial sequence
  Synthesized sequence
atgaagcagggcttgca

SEQ ID NO: 5366 - DNA, 17 bp, Artificial sequence
  Synthesized sequence
gcggccctgggcgtgct

SEQ ID NO: 5367 - DNA, 17 bp, Artificial sequence
  Synthesized sequence
ctggcccaggcgatcct

SEQ ID NO: 5368 - DNA, 17 bp, Artificial sequence
  Synthesized sequence
ctggcccaggcgatcct

SEQ ID NO: 5369 - DNA, 17 bp, Artificial sequence
  Synthesized sequence
gttgctcttctgttgcc

SEQ ID NO: 5370 - DNA, 17 bp, Artificial sequence
  Synthesized sequence
gtggccagcctgccgct

SEQ ID NO: 5371 - DNA, 17 bp, Artificial sequence
  Synthesized sequence
gcggcaaggagatcgcc

SEQ ID NO: 5372 - DNA, 17 bp, Artificial sequence
  Synthesized sequence
atggcgacacctttgga

SEQ ID NO: 5373 - DNA, 17 bp, Artificial sequence
  Synthesized sequence
ccggccggggttatgct

SEQ ID NO: 5374 - DNA, 17 bp, Artificial sequence
  Synthesized sequence
atggcagtgaattccct

SEQ ID NO: 5375 - DNA, 17 bp, Artificial sequence
  Synthesized sequence
ctggccaagggcatgcc

SEQ ID NO: 5376 - DNA, 17 bp, Artificial sequence
  Synthesized sequence
gtggtgcacttctcgcg

SEQ ID NO: 5377 - DNA, 17 bp, Artificial sequence
  Synthesized sequence
atcgaacgacgcctgcc

SEQ ID NO: 5378 - DNA, 17 bp, Artificial sequence
  Synthesized sequence
gcggccaggttgatgct

SEQ ID NO: 5379 - DNA, 17 bp, Artificial sequence
  Synthesized sequence
ccgccatggacattgcc

SEQ ID NO: 5380 - DNA, 17 bp, Artificial sequence
  Synthesized sequence
atggcgaaaccgatgcc

SEQ ID NO: 5381 - DNA, 17 bp, Artificial sequence
  Synthesized sequence
gcgacacttgtcttgcg

SEQ ID NO: 5382 - DNA, 17 bp, Artificial sequence
  Synthesized sequence
ttggcgcaggcggtgga

SEQ ID NO: 5383 - DNA, 17 bp, Artificial sequence
  Synthesized sequence
caggcccgggcctggcg

SEQ ID NO: 5384 - DNA, 17 bp, Artificial sequence
  Synthesized sequence
aaggcctggaaatggct

SEQ ID NO: 5385 - DNA, 17 bp, Artificial sequence
  Synthesized sequence
ttgacagggtgtatgcg

SEQ ID NO: 5386 - DNA, 17 bp, Artificial sequence
  Synthesized sequence
atggcgcgacgaccgcg

SEQ ID NO: 5387 - DNA, 17 bp, Artificial sequence
  Synthesized sequence
gaggcaagcgtatggcc

SEQ ID NO: 5388 - DNA, 17 bp, Artificial sequence
  Synthesized sequence
ctggcgctgcgtctgtt

SEQ ID NO: 5389 - DNA, 17 bp, Artificial sequence
  Synthesized sequence
ctggctgcggtcctgcc

SEQ ID NO: 5390 - DNA, 17 bp, Artificial sequence
  Synthesized sequence
atgggcggcaccatgct

SEQ ID NO: 5391 - DNA, 17 bp, Artificial sequence
  Synthesized sequence
ccggcaccgtcgttccc

SEQ ID NO: 5392 - DNA, 17 bp, Artificial sequence
  Synthesized sequence
atggaatggcaatccca

SEQ ID NO: 5393 - DNA, 17 bp, Artificial sequence
  Synthesized sequence
ctggcccgcgccgtggc

SEQ ID NO: 5394 - DNA, 17 bp, Artificial sequence
  Synthesized sequence
caggcagtgtcgttact

SEQ ID NO: 5395 - DNA, 17 bp, Artificial sequence
  Synthesized sequence
caggtacaggatctgcc

SEQ ID NO: 5396 - DNA, 17 bp, Artificial sequence
  Synthesized sequence
ctggcagaacggttcga

SEQ ID NO: 5397 - DNA, 17 bp, Artificial sequence
  Synthesized sequence
gtggaaagcgtcgggca

SEQ ID NO: 5398 - DNA, 17 bp, Artificial sequence
  Synthesized sequence
gtggcaccctgttcggc

SEQ ID NO: 5399 - DNA, 17 bp, Artificial sequence
  Synthesized sequence
ctggcaggagcactacg

SEQ ID NO: 5400 - DNA, 17 bp, Artificial sequence
  Synthesized sequence
ctggcagcgcagttcga

SEQ ID NO: 5401 - DNA, 17 bp, Artificial sequence
  Synthesized sequence
aaggcacggcgactccg

SEQ ID NO: 5402 - DNA, 17 bp, Artificial sequence
  Synthesized sequence
ctggcgcgcgcccagcg

SEQ ID NO: 5403 - DNA, 17 bp, Artificial sequence
  Synthesized sequence
atgatgcgtttcttgcc

SEQ ID NO: 5404 - DNA, 17 bp, Artificial sequence
  Synthesized sequence
cggccacgttttttcct

SEQ ID NO: 5405 - DNA, 17 bp, Artificial sequence
  Synthesized sequence
ctgggacgaggcgggcc

SEQ ID NO: 5406 - DNA, 17 bp, Artificial sequence
  Synthesized sequence
atggccctgtcgatgat

SEQ ID NO: 5407 - DNA, 17 bp, Artificial sequence
  Synthesized sequence
cgggccctggcggtgct

SEQ ID NO: 5408 - DNA, 17 bp, Artificial sequence
  Synthesized sequence
ctggaagccatctcgcg

SEQ ID NO: 5409 - DNA, 17 bp, Artificial sequence
  Synthesized sequence
ctggcgtggctgttcaa

SEQ ID NO: 5410 - DNA, 17 bp, Artificial sequence
  Synthesized sequence
atggcgctcggcccgct

SEQ ID NO: 5411 - DNA, 17 bp, Artificial sequence
  Synthesized sequence
ctggccgagcgcttccc

SEQ ID NO: 5412 - DNA, 17 bp, Artificial sequence
  Synthesized sequence
caggcgggaacgctgct

SEQ ID NO: 5413 - DNA, 17 bp, Artificial sequence
  Synthesized sequence
gtagcaggacgatcgcc

SEQ ID NO: 5414 - DNA, 17 bp, Artificial sequence
  Synthesized sequence
gcgccacgcatgctgcg

SEQ ID NO: 5415 - DNA, 17 bp, Artificial sequence
  Synthesized sequence
ccggcaccgtcgccgca

SEQ ID NO: 5416 - DNA, 17 bp, Artificial sequence
  Synthesized sequence
gtggaccactatctgcc

SEQ ID NO: 5417 - DNA, 17 bp, Artificial sequence
  Synthesized sequence
ctgccgctgaagctgct

SEQ ID NO: 5418 - DNA, 17 bp, Artificial sequence
  Synthesized sequence
gtggccggtcggtttcg

SEQ ID NO: 5419 - DNA, 17 bp, Artificial sequence
  Synthesized sequence
gcggcgcggcgttttcg

SEQ ID NO: 5420 - DNA, 17 bp, Artificial sequence
  Synthesized sequence
gtcgaaggccttctgct

SEQ ID NO: 5421 - DNA, 17 bp, Artificial sequence
  Synthesized sequence
atgttgcgaaaattgcc

SEQ ID NO: 5422 - DNA, 17 bp, Artificial sequence
  Synthesized sequence
ctcgcctgcgacgtgct

SEQ ID NO: 5423 - DNA, 17 bp, Artificial sequence
  Synthesized sequence
ctggcccagcgccagcg

SEQ ID NO: 5424 - DNA, 17 bp, Artificial sequence
  Synthesized sequence
caggaactgttcctgcg

SEQ ID NO: 5425 - DNA, 17 bp, Artificial sequence
  Synthesized sequence
ggggcatcgcgctcgcc

SEQ ID NO: 5426 - DNA, 17 bp, Artificial sequence
  Synthesized sequence
ctggaaaccctctcgcc

SEQ ID NO: 5427 - DNA, 17 bp, Artificial sequence
  Synthesized sequence
ccggccagcgtgctgct

SEQ ID NO: 5428 - DNA, 17 bp, Artificial sequence
  Synthesized sequence
ctggcatcatccgcgcc

SEQ ID NO: 5429 - DNA, 17 bp, Artificial sequence
  Synthesized sequence
ctggcccgctacatccg

SEQ ID NO: 5430 - DNA, 17 bp, Artificial sequence
  Synthesized sequence
ctggtgcggatcatcct

SEQ ID NO: 5431 - DNA, 17 bp, Artificial sequence
  Synthesized sequence
cgggcgacgttcttgcc

SEQ ID NO: 5432 - DNA, 17 bp, Artificial sequence
  Synthesized sequence
atggcggcgccgatgcc

SEQ ID NO: 5433 - DNA, 17 bp, Artificial sequence
  Synthesized sequence
agggcccgggacttgtc

SEQ ID NO: 5434 - DNA, 17 bp, Artificial sequence
  Synthesized sequence
ggggcctgccattggca

SEQ ID NO: 5435 - DNA, 17 bp, Artificial sequence
  Synthesized sequence
aaggcagcgatctggcg

SEQ ID NO: 5436 - DNA, 17 bp, Artificial sequence
  Synthesized sequence
ggggcacgtcacgcgcc

SEQ ID NO: 5437 - DNA, 17 bp, Artificial sequence
  Synthesized sequence
gttgaactgaatctgca

SEQ ID NO: 5438 - DNA, 17 bp, Artificial sequence
  Synthesized sequence
ctcgaacgcgccctgcg

SEQ ID NO: 5439 - DNA, 17 bp, Artificial sequence
  Synthesized sequence
gtgacgctgccgctgct

SEQ ID NO: 5440 - DNA, 17 bp, Artificial sequence
  Synthesized sequence
atgggccgatgatcgcg

SEQ ID NO: 5441 - DNA, 17 bp, Artificial sequence
  Synthesized sequence
atcgccccggaactgct

SEQ ID NO: 5442 - DNA, 17 bp, Artificial sequence
  Synthesized sequence
gtggaacctctggttct

SEQ ID NO: 5443 - DNA, 17 bp, Artificial sequence
  Synthesized sequence
tcggcatcgccctggcc

SEQ ID NO: 5444 - DNA, 17 bp, Artificial sequence
  Synthesized sequence
ccggcacgccctcggcg

SEQ ID NO: 5445 - DNA, 17 bp, Artificial sequence
  Synthesized sequence
gtggcaaaaagcctccg

SEQ ID NO: 5446 - DNA, 17 bp, Artificial sequence
  Synthesized sequence
gtggtccacgtctcgcc

SEQ ID NO: 5447 - DNA, 17 bp, Artificial sequence
  Synthesized sequence
agggcaagtccgtcgcc

SEQ ID NO: 5448 - DNA, 17 bp, Artificial sequence
  Synthesized sequence
atggccccggcgctggt

SEQ ID NO: 5449 - DNA, 17 bp, Artificial sequence
  Synthesized sequence
gaggaactcaagctgca

SEQ ID NO: 5450 - DNA, 17 bp, Artificial sequence
  Synthesized sequence
ctggcgccgctccagcg

SEQ ID NO: 5451 - DNA, 17 bp, Artificial sequence
  Synthesized sequence
ccggcccgaggctggcg

SEQ ID NO: 5452 - DNA, 17 bp, Artificial sequence
  Synthesized sequence
ctcgaagcgctcttgcg

SEQ ID NO: 5453 - DNA, 17 bp, Artificial sequence
  Synthesized sequence
gaggaacggcgcttccc

SEQ ID NO: 5454 - DNA, 17 bp, Artificial sequence
  Synthesized sequence
ctcgcccgcctgtagcg

SEQ ID NO: 5455 - DNA, 17 bp, Artificial sequence
  Synthesized sequence
atggccccgtcaatgat

SEQ ID NO: 5456 - DNA, 17 bp, Artificial sequence
  Synthesized sequence
caggaaggccaactgct

SEQ ID NO: 5457 - DNA, 17 bp, Artificial sequence
  Synthesized sequence
gtggcctcggcactgcc

SEQ ID NO: 5458 - DNA, 17 bp, Artificial sequence
  Synthesized sequence
atagaaggcaaattgcc

SEQ ID NO: 5459 - DNA, 17 bp, Artificial sequence
  Synthesized sequence
ctggaacagcaactggg

SEQ ID NO: 5460 - DNA, 17 bp, Artificial sequence
  Synthesized sequence
ccggcaaacggtttcca

SEQ ID NO: 5461 - DNA, 17 bp, Artificial sequence
  Synthesized sequence
ttggcatcagttcagcc

SEQ ID NO: 5462 - DNA, 17 bp, Artificial sequence
  Synthesized sequence
ctggaaccgcttcggcg

SEQ ID NO: 5463 - DNA, 17 bp, Artificial sequence
  Synthesized sequence
ctggaaccgcttcggcg

SEQ ID NO: 5464 - DNA, 17 bp, Artificial sequence
  Synthesized sequence
taggcatcgtgggtgcg

SEQ ID NO: 5465 - DNA, 17 bp, Artificial sequence
  Synthesized sequence
ctggccgggcgggcgct

SEQ ID NO: 5466 - DNA, 17 bp, Artificial sequence
  Synthesized sequence
gtggagcgaatcccgca

SEQ ID NO: 5467 - DNA, 17 bp, Artificial sequence
  Synthesized sequence
ccggcatcgtcctggcg

SEQ ID NO: 5468 - DNA, 17 bp, Artificial sequence
  Synthesized sequence
ggagcaggccggttgcg

SEQ ID NO: 5469 - DNA, 17 bp, Artificial sequence
  Synthesized sequence
ctggctggagcctttcc

SEQ ID NO: 5470 - DNA, 17 bp, Artificial sequence
  Synthesized sequence
ctggcgcaagctgtcca

SEQ ID NO: 5471 - DNA, 17 bp, Artificial sequence
  Synthesized sequence
tcggcgctggcctcgca

SEQ ID NO: 5472 - DNA, 17 bp, Artificial sequence
  Synthesized sequence
gtggaaggccttctgga

SEQ ID NO: 5473 - DNA, 17 bp, Artificial sequence
  Synthesized sequence
ctggcggcgcctgtgcc

SEQ ID NO: 5474 - DNA, 17 bp, Artificial sequence
  Synthesized sequence
tcggcatcattctcgcc

SEQ ID NO: 5475 - DNA, 17 bp, Artificial sequence
  Synthesized sequence
caagcacgacgcctgcc

SEQ ID NO: 5476 - DNA, 17 bp, Artificial sequence
  Synthesized sequence
ctggaaggcgtggcgct

SEQ ID NO: 5477 - DNA, 17 bp, Artificial sequence
  Synthesized sequence
ctggcagaccgtcggcc

SEQ ID NO: 5478 - DNA, 17 bp, Artificial sequence
  Synthesized sequence
ctgacctgccggctgct

SEQ ID NO: 5479 - DNA, 17 bp, Artificial sequence
  Synthesized sequence
atggaacttttcccgca

SEQ ID NO: 5480 - DNA, 17 bp, Artificial sequence
  Synthesized sequence
gcggcacgctgatgcct

SEQ ID NO: 5481 - DNA, 17 bp, Artificial sequence
  Synthesized sequence
cgggcattcctttcgcg

SEQ ID NO: 5482 - DNA, 17 bp, Artificial sequence
  Synthesized sequence
ccagcccggcgcttgcg

SEQ ID NO: 5483 - DNA, 17 bp, Artificial sequence
  Synthesized sequence
gtggcgatatggttggt

SEQ ID NO: 5484 - DNA, 17 bp, Artificial sequence
  Synthesized sequence
gcggcacgggacgtggc

SEQ ID NO: 5485 - DNA, 17 bp, Artificial sequence
  Synthesized sequence
ggggcggggcgaatgct

SEQ ID NO: 5486 - DNA, 17 bp, Artificial sequence
  Synthesized sequence
atcgccctgccgctgca

SEQ ID NO: 5487 - DNA, 17 bp, Artificial sequence
  Synthesized sequence
ctgtcctgggcgctgct

SEQ ID NO: 5488 - DNA, 17 bp, Artificial sequence
  Synthesized sequence
ctggcgccgcggatact

SEQ ID NO: 5489 - DNA, 17 bp, Artificial sequence
  Synthesized sequence
ctggtgcggcgcaagct

SEQ ID NO: 5490 - DNA, 17 bp, Artificial sequence
  Synthesized sequence
ctggcgcccgtgctcct

SEQ ID NO: 5491 - DNA, 17 bp, Artificial sequence
  Synthesized sequence
ctgtgccgccagttgcg

SEQ ID NO: 5492 - DNA, 17 bp, Artificial sequence
  Synthesized sequence
ctggctcatccggtgtt

SEQ ID NO: 5493 - DNA, 17 bp, Artificial sequence
  Synthesized sequence
caggataggcaattgca

SEQ ID NO: 5494 - DNA, 17 bp, Artificial sequence
  Synthesized sequence
ctggaactgggcgagct

SEQ ID NO: 5495 - DNA, 17 bp, Artificial sequence
  Synthesized sequence
gtggcccagccgctgag

SEQ ID NO: 5496 - DNA, 17 bp, Artificial sequence
  Synthesized sequence
gtgacagggcgttagcg

SEQ ID NO: 5497 - DNA, 17 bp, Artificial sequence
  Synthesized sequence
gaggaaccctactcgct

SEQ ID NO: 5498 - DNA, 17 bp, Artificial sequence
  Synthesized sequence
gtgacgcgcttctggcg

SEQ ID NO: 5499 - DNA, 17 bp, Artificial sequence
  Synthesized sequence
ctggcctgggcgctggt

SEQ ID NO: 5500 - DNA, 17 bp, Artificial sequence
  Synthesized sequence
cagtcaactattttgct

SEQ ID NO: 5501 - DNA, 17 bp, Artificial sequence
  Synthesized sequence
ctggcgacgtccatgcg

SEQ ID NO: 5502 - DNA, 17 bp, Artificial sequence
  Synthesized sequence
gtggccctggagatggt

SEQ ID NO: 5503 - DNA, 17 bp, Artificial sequence
  Synthesized sequence
atgacagcgctcatgcg

SEQ ID NO: 5504 - DNA, 17 bp, Artificial sequence
  Synthesized sequence
tggtcctggcgcttgca

SEQ ID NO: 5505 - DNA, 17 bp, Artificial sequence
  Synthesized sequence
ctggcgcctgcgtttcg

SEQ ID NO: 5506 - DNA, 17 bp, Artificial sequence
  Synthesized sequence
ctgccatatcgcctgcg

SEQ ID NO: 5507 - DNA, 17 bp, Artificial sequence
  Synthesized sequence
atggcgctgctgtggga

SEQ ID NO: 5508 - DNA, 17 bp, Artificial sequence
  Synthesized sequence
gtgtcaccgacgttgtc

SEQ ID NO: 5509 - DNA, 17 bp, Artificial sequence
  Synthesized sequence
atggccggagtaccgca

SEQ ID NO: 5510 - DNA, 17 bp, Artificial sequence
  Synthesized sequence
ctgtcgcgaaccatgcg

SEQ ID NO: 5511 - DNA, 17 bp, Artificial sequence
  Synthesized sequence
gcggccgggacgctgct

SEQ ID NO: 5512 - DNA, 17 bp, Artificial sequence
  Synthesized sequence
ggggccggtcggttgcc

SEQ ID NO: 5513 - DNA, 17 bp, Artificial sequence
  Synthesized sequence
cgggcagcggacttcca

SEQ ID NO: 5514 - DNA, 17 bp, Artificial sequence
  Synthesized sequence
ccggtaactgagttgca

SEQ ID NO: 5515 - DNA, 17 bp, Artificial sequence
  Synthesized sequence
tcggccagggtcttgaa

SEQ ID NO: 5516 - DNA, 17 bp, Artificial sequence
  Synthesized sequence
gtggaaaggctctgtct

SEQ ID NO: 5517 - DNA, 17 bp, Artificial sequence
  Synthesized sequence
gcggcctgcgccgtgca

SEQ ID NO: 5518 - DNA, 17 bp, Artificial sequence
  Synthesized sequence
tgggcgcggaagtcgcc

SEQ ID NO: 5519 - DNA, 17 bp, Artificial sequence
  Synthesized sequence
ctggggcgctattcgcc

SEQ ID NO: 5520 - DNA, 17 bp, Artificial sequence
  Synthesized sequence
ctgccgcaaggcctgca

SEQ ID NO: 5521 - DNA, 17 bp, Artificial sequence
  Synthesized sequence
aggggatgcatgttgtt

SEQ ID NO: 5522 - DNA, 17 bp, Artificial sequence
  Synthesized sequence
tgggcacgctggtggaa

SEQ ID NO: 5523 - DNA, 17 bp, Artificial sequence
  Synthesized sequence
ctggcgccgtcgctggt

SEQ ID NO: 5524 - DNA, 17 bp, Artificial sequence
  Synthesized sequence
caggctcaatgttcgca

SEQ ID NO: 5525 - DNA, 17 bp, Artificial sequence
  Synthesized sequence
gtgctcggcctgttgct

SEQ ID NO: 5526 - DNA, 17 bp, Artificial sequence
  Synthesized sequence
ctgcgccaggcgttgca

SEQ ID NO: 5527 - DNA, 17 bp, Artificial sequence
  Synthesized sequence
acggtgcggcgcatgct

SEQ ID NO: 5528 - DNA, 17 bp, Artificial sequence
  Synthesized sequence
gcgcgacggcagttgcg

SEQ ID NO: 5529 - DNA, 17 bp, Artificial sequence
  Synthesized sequence
ttgacaagggattggcg

SEQ ID NO: 5530 - DNA, 17 bp, Artificial sequence
  Synthesized sequence
gcggcacgcctttcgtg

SEQ ID NO: 5531 - DNA, 17 bp, Artificial sequence
  Synthesized sequence
ctgggacgaagacggcc

SEQ ID NO: 5532 - DNA, 17 bp, Artificial sequence
  Synthesized sequence
tacgcactgctttcgct

SEQ ID NO: 5533 - DNA, 17 bp, Artificial sequence
  Synthesized sequence
ttgggccaggcgctgcg

SEQ ID NO: 5534 - DNA, 17 bp, Artificial sequence
  Synthesized sequence
gcggccggggtgctgca

SEQ ID NO: 5535 - DNA, 17 bp, Artificial sequence
  Synthesized sequence
cgggcatccttgctgcc

SEQ ID NO: 5536 - DNA, 17 bp, Artificial sequence
  Synthesized sequence
ccggcagggcaaccgct

SEQ ID NO: 5537 - DNA, 17 bp, Artificial sequence
  Synthesized sequence
caggaatacaacgtgct

SEQ ID NO: 5538 - DNA, 17 bp, Artificial sequence
  Synthesized sequence
ctgccgcaggtcttcca

SEQ ID NO: 5539 - DNA, 17 bp, Artificial sequence
  Synthesized sequence
ctggcggcgagcatgcc

SEQ ID NO: 5540 - DNA, 17 bp, Artificial sequence
  Synthesized sequence
gttgcaggacggtggcg

SEQ ID NO: 5541 - DNA, 17 bp, Artificial sequence
  Synthesized sequence
ctggcgtgcggcctggt

SEQ ID NO: 5542 - DNA, 17 bp, Artificial sequence
  Synthesized sequence
gtgggcggagctatgct

SEQ ID NO: 5543 - DNA, 17 bp, Artificial sequence
  Synthesized sequence
acggcgcgcatcttacc

SEQ ID NO: 5544 - DNA, 17 bp, Artificial sequence
  Synthesized sequence
gttgcgcaggtgttcct

SEQ ID NO: 5545 - DNA, 17 bp, Artificial sequence
  Synthesized sequence
gcggcaggaggatggcg

SEQ ID NO: 5546 - DNA, 17 bp, Artificial sequence
  Synthesized sequence
ctcggacgaccgctgcc

SEQ ID NO: 5547 - DNA, 17 bp, Artificial sequence
  Synthesized sequence
ctgggcgaacgcctgct

SEQ ID NO: 5548 - DNA, 17 bp, Artificial sequence
  Synthesized sequence
ctgggcgaacgcctgct

SEQ ID NO: 5549 - DNA, 17 bp, Artificial sequence
  Synthesized sequence
ttgactcgttcgatgca

SEQ ID NO: 5550 - DNA, 17 bp, Artificial sequence
  Synthesized sequence
ctggcatccaggtcgta

SEQ ID NO: 5551 - DNA, 17 bp, Artificial sequence
  Synthesized sequence
gcggcttcgtatttgcc

SEQ ID NO: 5552 - DNA, 17 bp, Artificial sequence
  Synthesized sequence
ccggcacggtcggggcg

SEQ ID NO: 5553 - DNA, 17 bp, Artificial sequence
  Synthesized sequence
ctggcagtacgactaca

SEQ ID NO: 5554 - DNA, 17 bp, Artificial sequence
  Synthesized sequence
ctggaaacggatctgcg

SEQ ID NO: 5555 - DNA, 17 bp, Artificial sequence
  Synthesized sequence
ccggctggggtctggct

SEQ ID NO: 5556 - DNA, 17 bp, Artificial sequence
  Synthesized sequence
atcgcccagttgttcca

SEQ ID NO: 5557 - DNA, 17 bp, Artificial sequence
  Synthesized sequence
gaggcgcatactgtgca

SEQ ID NO: 5558 - DNA, 17 bp, Artificial sequence
  Synthesized sequence
gtgcaactgcgtctgct

SEQ ID NO: 5559 - DNA, 17 bp, Artificial sequence
  Synthesized sequence
ggggcgtggcagttcct

SEQ ID NO: 5560 - DNA, 17 bp, Artificial sequence
  Synthesized sequence
tcgacccggaccttgcc

SEQ ID NO: 5561 - DNA, 17 bp, Artificial sequence
  Synthesized sequence
ctggcgggtgtatttcc

SEQ ID NO: 5562 - DNA, 17 bp, Artificial sequence
  Synthesized sequence
tcggaaaaaaggttgcc

SEQ ID NO: 5563 - DNA, 17 bp, Artificial sequence
  Synthesized sequence
gtgggtacgcgcttgcc

SEQ ID NO: 5564 - DNA, 17 bp, Artificial sequence
  Synthesized sequence
atcgttcggacattgcg

SEQ ID NO: 5565 - DNA, 17 bp, Artificial sequence
  Synthesized sequence
tgggcacctttattccc

SEQ ID NO: 5566 - DNA, 17 bp, Artificial sequence
  Synthesized sequence
ctgggctgcgcatcgct

SEQ ID NO: 5567 - DNA, 17 bp, Artificial sequence
  Synthesized sequence
ctggaacgctctctggg

SEQ ID NO: 5568 - DNA, 17 bp, Artificial sequence
  Synthesized sequence
ctggaacatccgcttca

SEQ ID NO: 5569 - DNA, 17 bp, Artificial sequence
  Synthesized sequence
gtggctcgccgagggcg

SEQ ID NO: 5570 - DNA, 17 bp, Artificial sequence
  Synthesized sequence
gcgggtcgaccattgcc

SEQ ID NO: 5571 - DNA, 17 bp, Artificial sequence
  Synthesized sequence
gcgggacggcggtagcg

SEQ ID NO: 5572 - DNA, 17 bp, Artificial sequence
  Synthesized sequence
atgggaccgccgctgta

SEQ ID NO: 5573 - DNA, 17 bp, Artificial sequence
  Synthesized sequence
atggcgcctggatcgcc

SEQ ID NO: 5574 - DNA, 17 bp, Artificial sequence
  Synthesized sequence
gaggccggcgtctcgct

SEQ ID NO: 5575 - DNA, 17 bp, Artificial sequence
  Synthesized sequence
tcggcgtcgatcatgct

SEQ ID NO: 5576 - DNA, 17 bp, Artificial sequence
  Synthesized sequence
ctggccaaccgctggcc

SEQ ID NO: 5577 - DNA, 17 bp, Artificial sequence
  Synthesized sequence
ccggcatgaacagcgct

SEQ ID NO: 5578 - DNA, 17 bp, Artificial sequence
  Synthesized sequence
ctcgaacagctctcgcc

SEQ ID NO: 5579 - DNA, 17 bp, Artificial sequence
  Synthesized sequence
atggcgcagacccagcc

SEQ ID NO: 5580 - DNA, 17 bp, Artificial sequence
  Synthesized sequence
ccgccagcggtgttgca

SEQ ID NO: 5581 - DNA, 17 bp, Artificial sequence
  Synthesized sequence
ctggcctcgcttcagct

SEQ ID NO: 5582 - DNA, 17 bp, Artificial sequence
  Synthesized sequence
ctggaactggcgcagct

SEQ ID NO: 5583 - DNA, 17 bp, Artificial sequence
  Synthesized sequence
gaggcccgcgagctgcc

SEQ ID NO: 5584 - DNA, 17 bp, Artificial sequence
  Synthesized sequence
atggcagtcggtcggca

SEQ ID NO: 5585 - DNA, 17 bp, Artificial sequence
  Synthesized sequence
ctggaagaacagttgtg

SEQ ID NO: 5586 - DNA, 17 bp, Artificial sequence
  Synthesized sequence
atgtcaacgatattgaa

SEQ ID NO: 5587 - DNA, 17 bp, Artificial sequence
  Synthesized sequence
ccggcgcagagcctgcg

SEQ ID NO: 5588 - DNA, 17 bp, Artificial sequence
  Synthesized sequence
cagcaacagggcttgca

SEQ ID NO: 5589 - DNA, 17 bp, Artificial sequence
  Synthesized sequence
ctggttggggcctggct

SEQ ID NO: 5590 - DNA, 17 bp, Artificial sequence
  Synthesized sequence
ctggcaactgctccgct

SEQ ID NO: 5591 - DNA, 17 bp, Artificial sequence
  Synthesized sequence
atggcaagctggtcgag

SEQ ID NO: 5592 - DNA, 17 bp, Artificial sequence
  Synthesized sequence
taggctcggctcgggct

SEQ ID NO: 5593 - DNA, 17 bp, Artificial sequence
  Synthesized sequence
aatgtacatttattgct

SEQ ID NO: 5594 - DNA, 17 bp, Artificial sequence
  Synthesized sequence
atggaactggaagagct

SEQ ID NO: 5595 - DNA, 17 bp, Artificial sequence
  Synthesized sequence
atggaactggaagagct

SEQ ID NO: 5596 - DNA, 17 bp, Artificial sequence
  Synthesized sequence
atggcaatggcggtgga

SEQ ID NO: 5597 - DNA, 17 bp, Artificial sequence
  Synthesized sequence
ttggcaactgatcggct

SEQ ID NO: 5598 - DNA, 17 bp, Artificial sequence
  Synthesized sequence
ctggaaaggcacataca

SEQ ID NO: 5599 - DNA, 17 bp, Artificial sequence
  Synthesized sequence
gcgaaacagggcttgca

SEQ ID NO: 5600 - DNA, 17 bp, Artificial sequence
  Synthesized sequence
gttgcaacccggctgca

SEQ ID NO: 5601 - DNA, 17 bp, Artificial sequence
  Synthesized sequence
cagggcctggcgttgca

SEQ ID NO: 5602 - DNA, 17 bp, Artificial sequence
  Synthesized sequence
gtggcccgcagcctgac

SEQ ID NO: 5603 - DNA, 17 bp, Artificial sequence
  Synthesized sequence
ctggcgctgagcctgta

SEQ ID NO: 5604 - DNA, 17 bp, Artificial sequence
  Synthesized sequence
ctggccgaggtgttccg

SEQ ID NO: 5605 - DNA, 17 bp, Artificial sequence
  Synthesized sequence
gtggcgcaactgctgag

SEQ ID NO: 5606 - DNA, 17 bp, Artificial sequence
  Synthesized sequence
ctggagcagtcgatgcg

SEQ ID NO: 5607 - DNA, 17 bp, Artificial sequence
  Synthesized sequence
tcggcccggtgctggcc

SEQ ID NO: 5608 - DNA, 17 bp, Artificial sequence
  Synthesized sequence
caggccggcaccctgct

SEQ ID NO: 5609 - DNA, 17 bp, Artificial sequence
  Synthesized sequence
ctgggcggcgccgtgct

SEQ ID NO: 5610 - DNA, 17 bp, Artificial sequence
  Synthesized sequence
ttcgccgggctctggct

SEQ ID NO: 5611 - DNA, 17 bp, Artificial sequence
  Synthesized sequence
ctggccggtggttcgcg

SEQ ID NO: 5612 - DNA, 17 bp, Artificial sequence
  Synthesized sequence
cgggtaaacctcctgca

SEQ ID NO: 5613 - DNA, 17 bp, Artificial sequence
  Synthesized sequence
gtggcctggcgctcgga

SEQ ID NO: 5614 - DNA, 17 bp, Artificial sequence
  Synthesized sequence
aaggccctggaggtgca

SEQ ID NO: 5615 - DNA, 17 bp, Artificial sequence
  Synthesized sequence
ctggcgcgcggcttcga

SEQ ID NO: 5616 - DNA, 17 bp, Artificial sequence
  Synthesized sequence
cgggcacggcggcagcc

SEQ ID NO: 5617 - DNA, 17 bp, Artificial sequence
  Synthesized sequence
ttgtaccagcttttgcc

SEQ ID NO: 5618 - DNA, 17 bp, Artificial sequence
  Synthesized sequence
ctcgccctggacctgca

SEQ ID NO: 5619 - DNA, 17 bp, Artificial sequence
  Synthesized sequence
tcggcaacatccttgaa

SEQ ID NO: 5620 - DNA, 17 bp, Artificial sequence
  Synthesized sequence
ccggcatcgccatggcg

SEQ ID NO: 5621 - DNA, 17 bp, Artificial sequence
  Synthesized sequence
gcggcaagctggtggcg

SEQ ID NO: 5622 - DNA, 17 bp, Artificial sequence
  Synthesized sequence
ttcgcccaggacttcct

SEQ ID NO: 5623 - DNA, 17 bp, Artificial sequence
  Synthesized sequence
ctggccgagctgctgat

SEQ ID NO: 5624 - DNA, 17 bp, Artificial sequence
  Synthesized sequence
caggcgcaggccttcca

SEQ ID NO: 5625 - DNA, 17 bp, Artificial sequence
  Synthesized sequence
ctgggcctcccgtggct

SEQ ID NO: 5626 - DNA, 17 bp, Artificial sequence
  Synthesized sequence
tcggctccccgggtgct

SEQ ID NO: 5627 - DNA, 17 bp, Artificial sequence
  Synthesized sequence
ctggcagttcaggtact

SEQ ID NO: 5628 - DNA, 17 bp, Artificial sequence
  Synthesized sequence
gaggcacgatgcgcgcg

SEQ ID NO: 5629 - DNA, 17 bp, Artificial sequence
  Synthesized sequence
ccggcgctggggctgct

SEQ ID NO: 5630 - DNA, 17 bp, Artificial sequence
  Synthesized sequence
tcggcccgcagtatgcc

SEQ ID NO: 5631 - DNA, 17 bp, Artificial sequence
  Synthesized sequence
ttggcaagcagctcgtc

SEQ ID NO: 5632 - DNA, 17 bp, Artificial sequence
  Synthesized sequence
ctgcgccacgccttgca

SEQ ID NO: 5633 - DNA, 17 bp, Artificial sequence
  Synthesized sequence
ctggccggctttgcgct

SEQ ID NO: 5634 - DNA, 17 bp, Artificial sequence
  Synthesized sequence
gtggtagatgctttcca

SEQ ID NO: 5635 - DNA, 17 bp, Artificial sequence
  Synthesized sequence
ccggctcgccgctggcg

SEQ ID NO: 5636 - DNA, 17 bp, Artificial sequence
  Synthesized sequence
ctggaacgaccgatggc

SEQ ID NO: 5637 - DNA, 17 bp, Artificial sequence
  Synthesized sequence
ctggcgcgcgagcagcg

SEQ ID NO: 5638 - DNA, 17 bp, Artificial sequence
  Synthesized sequence
tcggcgccggcctcgct

SEQ ID NO: 5639 - DNA, 17 bp, Artificial sequence
  Synthesized sequence
ctggcgctgctgtacct

SEQ ID NO: 5640 - DNA, 17 bp, Artificial sequence
  Synthesized sequence
cgggcgcgaagtgtgcc

SEQ ID NO: 5641 - DNA, 17 bp, Artificial sequence
  Synthesized sequence
gtggccccgtttttatt

SEQ ID NO: 5642 - DNA, 17 bp, Artificial sequence
  Synthesized sequence
cgggcaagggcatggcc

SEQ ID NO: 5643 - DNA, 17 bp, Artificial sequence
  Synthesized sequence
atggctggcctgcggct

SEQ ID NO: 5644 - DNA, 17 bp, Artificial sequence
  Synthesized sequence
tcggcatcgactatgcc

SEQ ID NO: 5645 - DNA, 17 bp, Artificial sequence
  Synthesized sequence
ctggcaccatcgttcac

SEQ ID NO: 5646 - DNA, 17 bp, Artificial sequence
  Synthesized sequence
ttgccagaaaccctgcg

SEQ ID NO: 5647 - DNA, 17 bp, Artificial sequence
  Synthesized sequence
ttgacgcggcaggtgcc

SEQ ID NO: 5648 - DNA, 17 bp, Artificial sequence
  Synthesized sequence
gtggcagcgccattttt

SEQ ID NO: 5649 - DNA, 17 bp, Artificial sequence
  Synthesized sequence
ctggcagtgcactttga

SEQ ID NO: 5650 - DNA, 17 bp, Artificial sequence
  Synthesized sequence
ctggcgccgccgctgga

SEQ ID NO: 5651 - DNA, 17 bp, Artificial sequence
  Synthesized sequence
ctggcgccgatcttctt

SEQ ID NO: 5652 - DNA, 17 bp, Artificial sequence
  Synthesized sequence
gcggcgctgccgtggct

SEQ ID NO: 5653 - DNA, 17 bp, Artificial sequence
  Synthesized sequence
ctggtgggcgaagtgct

SEQ ID NO: 5654 - DNA, 17 bp, Artificial sequence
  Synthesized sequence
ttgggaccgggccggca

SEQ ID NO: 5655 - DNA, 17 bp, Artificial sequence
  Synthesized sequence
aaggccagggatgtgct

SEQ ID NO: 5656 - DNA, 17 bp, Artificial sequence
  Synthesized sequence
gtggcgcgggatcttcc

SEQ ID NO: 5657 - DNA, 17 bp, Artificial sequence
  Synthesized sequence
tcggtacgcgcggtgcc

SEQ ID NO: 5658 - DNA, 17 bp, Artificial sequence
  Synthesized sequence
gtggccagccgcatgtt

SEQ ID NO: 5659 - DNA, 17 bp, Artificial sequence
  Synthesized sequence
ctggcgtcggcctggcc

SEQ ID NO: 5660 - DNA, 17 bp, Artificial sequence
  Synthesized sequence
ctggccatgtacctgcc

SEQ ID NO: 5661 - DNA, 17 bp, Artificial sequence
  Synthesized sequence
ataacactccgcttgcg

SEQ ID NO: 5662 - DNA, 17 bp, Artificial sequence
  Synthesized sequence
atggtgctggccttcct

SEQ ID NO: 5663 - DNA, 17 bp, Artificial sequence
  Synthesized sequence
attgcgcactttttgat

SEQ ID NO: 5664 - DNA, 17 bp, Artificial sequence
  Synthesized sequence
ccggcccggaaatggcc

SEQ ID NO: 5665 - DNA, 17 bp, Artificial sequence
  Synthesized sequence
atggagttcctcatgct

SEQ ID NO: 5666 - DNA, 17 bp, Artificial sequence
  Synthesized sequence
agggcaagccggtggcc

SEQ ID NO: 5667 - DNA, 17 bp, Artificial sequence
  Synthesized sequence
gcggctcgcaaactgcc

SEQ ID NO: 5668 - DNA, 17 bp, Artificial sequence
  Synthesized sequence
ccggccgggatttcgca

SEQ ID NO: 5669 - DNA, 17 bp, Artificial sequence
  Synthesized sequence
ctgggctgactggtgcg

SEQ ID NO: 5670 - DNA, 17 bp, Artificial sequence
  Synthesized sequence
atggcatggggattcgc

SEQ ID NO: 5671 - DNA, 17 bp, Artificial sequence
  Synthesized sequence
ctggtacgcatctttgg

SEQ ID NO: 5672 - DNA, 17 bp, Artificial sequence
  Synthesized sequence
aggccacgctgctggca

SEQ ID NO: 5673 - DNA, 17 bp, Artificial sequence
  Synthesized sequence
ctgctaagcctggtgct

SEQ ID NO: 5674 - DNA, 17 bp, Artificial sequence
  Synthesized sequence
atggcctggtgggcgca

SEQ ID NO: 5675 - DNA, 17 bp, Artificial sequence
  Synthesized sequence
ctggccctggcgctgat

SEQ ID NO: 5676 - DNA, 17 bp, Artificial sequence
  Synthesized sequence
atggtgcggtggttggc

SEQ ID NO: 5677 - DNA, 17 bp, Artificial sequence
  Synthesized sequence
tcggcaaatttgctgcg

SEQ ID NO: 5678 - DNA, 17 bp, Artificial sequence
  Synthesized sequence
tggccatggctgtggct

SEQ ID NO: 5679 - DNA, 17 bp, Artificial sequence
  Synthesized sequence
gtgccgtgctacatgct

SEQ ID NO: 5680 - DNA, 17 bp, Artificial sequence
  Synthesized sequence
gtgacgcaaatgttgta

SEQ ID NO: 5681 - DNA, 17 bp, Artificial sequence
  Synthesized sequence
ggggtgtagaccttgca

SEQ ID NO: 5682 - DNA, 17 bp, Artificial sequence
  Synthesized sequence
tcggcactgtttctgta

SEQ ID NO: 5683 - DNA, 17 bp, Artificial sequence
  Synthesized sequence
cgggtactggcctcgca

SEQ ID NO: 5684 - DNA, 17 bp, Artificial sequence
  Synthesized sequence
ctgtcgcagcgatggct

SEQ ID NO: 5685 - DNA, 17 bp, Artificial sequence
  Synthesized sequence
aaggcaaactaagtgcg

SEQ ID NO: 5686 - DNA, 17 bp, Artificial sequence
  Synthesized sequence
attgcctgggaagtgct

SEQ ID NO: 5687 - DNA, 17 bp, Artificial sequence
  Synthesized sequence
ctggcgtcggtattggc

SEQ ID NO: 5688 - DNA, 17 bp, Artificial sequence
  Synthesized sequence
gtggaaagtcggttgtc

SEQ ID NO: 5689 - DNA, 17 bp, Artificial sequence
  Synthesized sequence
atggccgcctgcttcca

SEQ ID NO: 5690 - DNA, 17 bp, Artificial sequence
  Synthesized sequence
ctggtaccgcaccggcg

SEQ ID NO: 5691 - DNA, 17 bp, Artificial sequence
  Synthesized sequence
ctggatgaactgctgct

SEQ ID NO: 5692 - DNA, 17 bp, Artificial sequence
  Synthesized sequence
ctggcgatgttctggcc

SEQ ID NO: 5693 - DNA, 17 bp, Artificial sequence
  Synthesized sequence
atggcgaactggatgcg

SEQ ID NO: 5694 - DNA, 17 bp, Artificial sequence
  Synthesized sequence
aaggcgctggcggtgct

SEQ ID NO: 5695 - DNA, 17 bp, Artificial sequence
  Synthesized sequence
gtggttggcgtctcgca

SEQ ID NO: 5696 - DNA, 17 bp, Artificial sequence
  Synthesized sequence
ctcgcacgacgcccgcg

SEQ ID NO: 5697 - DNA, 17 bp, Artificial sequence
  Synthesized sequence
cgggcatcccctctgcg

SEQ ID NO: 5698 - DNA, 17 bp, Artificial sequence
  Synthesized sequence
ttcgcaccgatcctgta

SEQ ID NO: 5699 - DNA, 17 bp, Artificial sequence
  Synthesized sequence
ctggaacaggagttcgt

SEQ ID NO: 5700 - DNA, 17 bp, Artificial sequence
  Synthesized sequence
gcagcacaatcactgct

SEQ ID NO: 5701 - DNA, 17 bp, Artificial sequence
  Synthesized sequence
ctggcacgacgccgacg

SEQ ID NO: 5702 - DNA, 17 bp, Artificial sequence
  Synthesized sequence
ctggcgagtatgttccc

SEQ ID NO: 5703 - DNA, 17 bp, Artificial sequence
  Synthesized sequence
ctggcgagtatgttccc

SEQ ID NO: 5704 - DNA, 17 bp, Artificial sequence
  Synthesized sequence
cgggcccaggaattcca

SEQ ID NO: 5705 - DNA, 17 bp, Artificial sequence
  Synthesized sequence
taggccacggtcttgcc

SEQ ID NO: 5706 - DNA, 17 bp, Artificial sequence
  Synthesized sequence
ttgccactggccttggc

SEQ ID NO: 5707 - DNA, 17 bp, Artificial sequence
  Synthesized sequence
ctggacaagccggtgct

SEQ ID NO: 5708 - DNA, 17 bp, Artificial sequence
  Synthesized sequence
gtggatcgactccggca

SEQ ID NO: 5709 - DNA, 17 bp, Artificial sequence
  Synthesized sequence
gtggcggcgatcttccg

SEQ ID NO: 5710 - DNA, 17 bp, Artificial sequence
  Synthesized sequence
caggtgcggcagctgct

SEQ ID NO: 5711 - DNA, 17 bp, Artificial sequence
  Synthesized sequence
caggcatgccgggggct

SEQ ID NO: 5712 - DNA, 17 bp, Artificial sequence
  Synthesized sequence
ctggaaaccctgtcgcg

SEQ ID NO: 5713 - DNA, 17 bp, Artificial sequence
  Synthesized sequence
atcgccctggtgctgca

SEQ ID NO: 5714 - DNA, 17 bp, Artificial sequence
  Synthesized sequence
ctggatcgccggtggcc

SEQ ID NO: 5715 - DNA, 17 bp, Artificial sequence
  Synthesized sequence
cagggcccggcgttgca

SEQ ID NO: 5716 - DNA, 17 bp, Artificial sequence
  Synthesized sequence
ctgcctcatcccgtgct

SEQ ID NO: 5717 - DNA, 17 bp, Artificial sequence
  Synthesized sequence
gtggaacagcgcctgac

SEQ ID NO: 5718 - DNA, 17 bp, Artificial sequence
  Synthesized sequence
ttggggccgacttggca

SEQ ID NO: 5719 - DNA, 17 bp, Artificial sequence
  Synthesized sequence
ttggggccgacttggca

SEQ ID NO: 5720 - DNA, 17 bp, Artificial sequence
  Synthesized sequence
agggcaagtcgctggcc

SEQ ID NO: 5721 - DNA, 17 bp, Artificial sequence
  Synthesized sequence
ctgggtccggcgctgca

SEQ ID NO: 5722 - DNA, 17 bp, Artificial sequence
  Synthesized sequence
ccggttcggctatcgct

SEQ ID NO: 5723 - DNA, 17 bp, Artificial sequence
  Synthesized sequence
gtgggaaggcagcttct

SEQ ID NO: 5724 - DNA, 17 bp, Artificial sequence
  Synthesized sequence
ctggcgggatatccgct

SEQ ID NO: 5725 - DNA, 17 bp, Artificial sequence
  Synthesized sequence
gcggcggaggcgttgcg

SEQ ID NO: 5726 - DNA, 17 bp, Artificial sequence
  Synthesized sequence
ccggcaagcgttttccc

SEQ ID NO: 5727 - DNA, 17 bp, Artificial sequence
  Synthesized sequence
taggcatcgagctcgcc

SEQ ID NO: 5728 - DNA, 17 bp, Artificial sequence
  Synthesized sequence
gtatcgcgctcgttgct

SEQ ID NO: 5729 - DNA, 17 bp, Artificial sequence
  Synthesized sequence
ctggcgcgcggcctggg

SEQ ID NO: 5730 - DNA, 17 bp, Artificial sequence
  Synthesized sequence
ctggcgcgcgtgctgtc

SEQ ID NO: 5731 - DNA, 17 bp, Artificial sequence
  Synthesized sequence
ctcgccagcctgctgct

SEQ ID NO: 5732 - DNA, 17 bp, Artificial sequence
  Synthesized sequence
ttcgccccgcttttggt

SEQ ID NO: 5733 - DNA, 17 bp, Artificial sequence
  Synthesized sequence
atagccggacccgtgct

SEQ ID NO: 5734 - DNA, 17 bp, Artificial sequence
  Synthesized sequence
ctggtgcaatcgctgcc

SEQ ID NO: 5735 - DNA, 17 bp, Artificial sequence
  Synthesized sequence
acggggcggcgcatgct

SEQ ID NO: 5736 - DNA, 17 bp, Artificial sequence
  Synthesized sequence
atcggccaggcgttgca

SEQ ID NO: 5737 - DNA, 17 bp, Artificial sequence
  Synthesized sequence
cgggcgcggcgcttggc

SEQ ID NO: 5738 - DNA, 17 bp, Artificial sequence
  Synthesized sequence
ggggaacactgcttgga

SEQ ID NO: 5739 - DNA, 17 bp, Artificial sequence
  Synthesized sequence
atggcgcgcgcccggcc

SEQ ID NO: 5740 - DNA, 17 bp, Artificial sequence
  Synthesized sequence
cgggcaaaaacctcgcc

SEQ ID NO: 5741 - DNA, 17 bp, Artificial sequence
  Synthesized sequence
gtcgttcacggcttgca

SEQ ID NO: 5742 - DNA, 17 bp, Artificial sequence
  Synthesized sequence
gtcgttcacggcttgca

SEQ ID NO: 5743 - DNA, 17 bp, Artificial sequence
  Synthesized sequence
caggccggtatcctgca

SEQ ID NO: 5744 - DNA, 17 bp, Artificial sequence
  Synthesized sequence
gcgttaccccccttgct

SEQ ID NO: 5745 - DNA, 17 bp, Artificial sequence
  Synthesized sequence
atggcgggccttcagca

SEQ ID NO: 5746 - DNA, 17 bp, Artificial sequence
  Synthesized sequence
caggcagaggatctgcc

SEQ ID NO: 5747 - DNA, 17 bp, Artificial sequence
  Synthesized sequence
gtgccacggcgcaggcg

SEQ ID NO: 5748 - DNA, 17 bp, Artificial sequence
  Synthesized sequence
atgccgccgaagctgct

SEQ ID NO: 5749 - DNA, 17 bp, Artificial sequence
  Synthesized sequence
ttggacaggctcatgcg

SEQ ID NO: 5750 - DNA, 17 bp, Artificial sequence
  Synthesized sequence
atggccggggtgctgaa

SEQ ID NO: 5751 - DNA, 17 bp, Artificial sequence
  Synthesized sequence
gtggcgttgtcggtgcc

SEQ ID NO: 5752 - DNA, 17 bp, Artificial sequence
  Synthesized sequence
tcggcaggaggatcgcc

SEQ ID NO: 5753 - DNA, 17 bp, Artificial sequence
  Synthesized sequence
ttggccaggtgcacgct

SEQ ID NO: 5754 - DNA, 17 bp, Artificial sequence
  Synthesized sequence
atggcgggtctccggca

SEQ ID NO: 5755 - DNA, 17 bp, Artificial sequence
  Synthesized sequence
atgccgctctacctgct

SEQ ID NO: 5756 - DNA, 17 bp, Artificial sequence
  Synthesized sequence
ctcgcctggcgctggct

SEQ ID NO: 5757 - DNA, 17 bp, Artificial sequence
  Synthesized sequence
atgccaggcgcattcca

SEQ ID NO: 5758 - DNA, 17 bp, Artificial sequence
  Synthesized sequence
ccggcgggcgtggtgct

SEQ ID NO: 5759 - DNA, 17 bp, Artificial sequence
  Synthesized sequence
ctggaacggcattcggc

SEQ ID NO: 5760 - DNA, 17 bp, Artificial sequence
  Synthesized sequence
atggcgcggcggatacg

SEQ ID NO: 5761 - DNA, 17 bp, Artificial sequence
  Synthesized sequence
gcggccggcccgctgct

SEQ ID NO: 5762 - DNA, 17 bp, Artificial sequence
  Synthesized sequence
ctggtcctgcgcctgcc

SEQ ID NO: 5763 - DNA, 17 bp, Artificial sequence
  Synthesized sequence
gtgggacgcgcattcgt

SEQ ID NO: 5764 - DNA, 17 bp, Artificial sequence
  Synthesized sequence
ttggtcggcgaggtgct

SEQ ID NO: 5765 - DNA, 17 bp, Artificial sequence
  Synthesized sequence
gtggcgcaactggagcg

SEQ ID NO: 5766 - DNA, 17 bp, Artificial sequence
  Synthesized sequence
tcggcgcggtgttcgcg

SEQ ID NO: 5767 - DNA, 17 bp, Artificial sequence
  Synthesized sequence
gcggcacgaccagcgcc

SEQ ID NO: 5768 - DNA, 17 bp, Artificial sequence
  Synthesized sequence
cctgcatgactggtgca

SEQ ID NO: 5769 - DNA, 17 bp, Artificial sequence
  Synthesized sequence
ctgccgcaacgcttcct

SEQ ID NO: 5770 - DNA, 17 bp, Artificial sequence
  Synthesized sequence
gtcggacgtctcctgcc

SEQ ID NO: 5771 - DNA, 17 bp, Artificial sequence
  Synthesized sequence
atggacctggcgtcgct

SEQ ID NO: 5772 - DNA, 17 bp, Artificial sequence
  Synthesized sequence
attgctcgccctctgcg

SEQ ID NO: 5773 - DNA, 17 bp, Artificial sequence
  Synthesized sequence
ctggcggcgacgctgcg

SEQ ID NO: 5774 - DNA, 17 bp, Artificial sequence
  Synthesized sequence
caggcctgcgcgctgca

SEQ ID NO: 5775 - DNA, 17 bp, Artificial sequence
  Synthesized sequence
ctgtcgtaggccttgcc

SEQ ID NO: 5776 - DNA, 17 bp, Artificial sequence
  Synthesized sequence
ctggcgccggtctggga

SEQ ID NO: 5777 - DNA, 17 bp, Artificial sequence
  Synthesized sequence
ctggaactgacggtgaa

SEQ ID NO: 5778 - DNA, 17 bp, Artificial sequence
  Synthesized sequence
ctgcagcgacagttgcc

SEQ ID NO: 5779 - DNA, 17 bp, Artificial sequence
  Synthesized sequence
ctggccctggccaagca

SEQ ID NO: 5780 - DNA, 17 bp, Artificial sequence
  Synthesized sequence
ctggcgccatgcgagca

SEQ ID NO: 5781 - DNA, 17 bp, Artificial sequence
  Synthesized sequence
agggcgctggtgtagct

SEQ ID NO: 5782 - DNA, 17 bp, Artificial sequence
  Synthesized sequence
gtggcccataccatcca

SEQ ID NO: 5783 - DNA, 17 bp, Artificial sequence
  Synthesized sequence
atcgcctgcaagctgct

SEQ ID NO: 5784 - DNA, 17 bp, Artificial sequence
  Synthesized sequence
tttgcaagggacttccg

SEQ ID NO: 5785 - DNA, 17 bp, Artificial sequence
  Synthesized sequence
ctgacccgtttcctgcc

SEQ ID NO: 5786 - DNA, 17 bp, Artificial sequence
  Synthesized sequence
ttggtgcgcggttggcg

SEQ ID NO: 5787 - DNA, 17 bp, Artificial sequence
  Synthesized sequence
gtcgcacggcgattctt

SEQ ID NO: 5788 - DNA, 17 bp, Artificial sequence
  Synthesized sequence
ctcgccggcttcctgct

SEQ ID NO: 5789 - DNA, 17 bp, Artificial sequence
  Synthesized sequence
gtgcaaccgccggtgct

SEQ ID NO: 5790 - DNA, 17 bp, Artificial sequence
  Synthesized sequence
atggcaagaccatcacc

SEQ ID NO: 5791 - DNA, 17 bp, Artificial sequence
  Synthesized sequence
aaggccggacgcctgca

SEQ ID NO: 5792 - DNA, 17 bp, Artificial sequence
  Synthesized sequence
ctggccctgctcgagcg

SEQ ID NO: 5793 - DNA, 17 bp, Artificial sequence
  Synthesized sequence
ccggcagcaccgttcca

SEQ ID NO: 5794 - DNA, 17 bp, Artificial sequence
  Synthesized sequence
cgggcgacgcttttgcc

SEQ ID NO: 5795 - DNA, 17 bp, Artificial sequence
  Synthesized sequence
gtcgccgccgccttgca

SEQ ID NO: 5796 - DNA, 17 bp, Artificial sequence
  Synthesized sequence
cgagcgcagcgattgca

SEQ ID NO: 5797 - DNA, 17 bp, Artificial sequence
  Synthesized sequence
atggaaaggggtttacc

SEQ ID NO: 5798 - DNA, 17 bp, Artificial sequence
  Synthesized sequence
tcggcacactgaaggca

SEQ ID NO: 5799 - DNA, 17 bp, Artificial sequence
  Synthesized sequence
ctggcctcctcgctgcg

SEQ ID NO: 5800 - DNA, 17 bp, Artificial sequence
  Synthesized sequence
ctggaaggcgagttccc

SEQ ID NO: 5801 - DNA, 17 bp, Artificial sequence
  Synthesized sequence
gttgtagggatctggct

SEQ ID NO: 5802 - DNA, 17 bp, Artificial sequence
  Synthesized sequence
atgccgacggcgttgct

SEQ ID NO: 5803 - DNA, 17 bp, Artificial sequence
  Synthesized sequence
ctggcgccggacgagca

SEQ ID NO: 5804 - DNA, 17 bp, Artificial sequence
  Synthesized sequence
agggaacccctgttgtt

SEQ ID NO: 5805 - DNA, 17 bp, Artificial sequence
  Synthesized sequence
ctggacgacctgctgca

SEQ ID NO: 5806 - DNA, 17 bp, Artificial sequence
  Synthesized sequence
ttggcgcaacgttaact

SEQ ID NO: 5807 - DNA, 17 bp, Artificial sequence
  Synthesized sequence
gtcgcgtgcgtcctgca

SEQ ID NO: 5808 - DNA, 17 bp, Artificial sequence
  Synthesized sequence
gacgcacgcgacttgga

SEQ ID NO: 5809 - DNA, 17 bp, Artificial sequence
  Synthesized sequence
gacgcacgcgacttgga

SEQ ID NO: 5810 - DNA, 17 bp, Artificial sequence
  Synthesized sequence
tgggcgcggcggtagcg

SEQ ID NO: 5811 - DNA, 17 bp, Artificial sequence
  Synthesized sequence
ctggagcgggccttggc

SEQ ID NO: 5812 - DNA, 17 bp, Artificial sequence
  Synthesized sequence
gaggcgccgtcgctgca

SEQ ID NO: 5813 - DNA, 17 bp, Artificial sequence
  Synthesized sequence
caggcgcacgccttcct

SEQ ID NO: 5814 - DNA, 17 bp, Artificial sequence
  Synthesized sequence
gcggcgaggcgctggct

SEQ ID NO: 5815 - DNA, 17 bp, Artificial sequence
  Synthesized sequence
gtggcccagggcttcat

SEQ ID NO: 5816 - DNA, 17 bp, Artificial sequence
  Synthesized sequence
ctgccgcaggattggct

SEQ ID NO: 5817 - DNA, 17 bp, Artificial sequence
  Synthesized sequence
ctggcccgggcagttcg

SEQ ID NO: 5818 - DNA, 17 bp, Artificial sequence
  Synthesized sequence
gtggtcggcgggctgct

SEQ ID NO: 5819 - DNA, 17 bp, Artificial sequence
  Synthesized sequence
atcgaacaagtgttgtt

SEQ ID NO: 5820 - DNA, 17 bp, Artificial sequence
  Synthesized sequence
ctggcgctacagattct

SEQ ID NO: 5821 - DNA, 17 bp, Artificial sequence
  Synthesized sequence
aggggacgacgggtgcc

SEQ ID NO: 5822 - DNA, 17 bp, Artificial sequence
  Synthesized sequence
tgggcctgggcttcgct

SEQ ID NO: 5823 - DNA, 17 bp, Artificial sequence
  Synthesized sequence
gaggccctgcaattcct

SEQ ID NO: 5824 - DNA, 17 bp, Artificial sequence
  Synthesized sequence
ccggcaagactactgaa

SEQ ID NO: 5825 - DNA, 17 bp, Artificial sequence
  Synthesized sequence
cgggtcagccagttgca

SEQ ID NO: 5826 - DNA, 17 bp, Artificial sequence
  Synthesized sequence
gtggcgcgtcccctggg

SEQ ID NO: 5827 - DNA, 17 bp, Artificial sequence
  Synthesized sequence
gtggcgcgtcccctggg

SEQ ID NO: 5828 - DNA, 17 bp, Artificial sequence
  Synthesized sequence
ctggaacatgccgggca

SEQ ID NO: 5829 - DNA, 17 bp, Artificial sequence
  Synthesized sequence
ctggcgcaggattacca

SEQ ID NO: 5830 - DNA, 17 bp, Artificial sequence
  Synthesized sequence
gaggcgcgtcgtctgcg

SEQ ID NO: 5831 - DNA, 17 bp, Artificial sequence
  Synthesized sequence
ctggcgccgctgtacca

SEQ ID NO: 5832 - DNA, 17 bp, Artificial sequence
  Synthesized sequence
ctggcgccgctgtacca

SEQ ID NO: 5833 - DNA, 17 bp, Artificial sequence
  Synthesized sequence
ctggaagtcgctttcct

SEQ ID NO: 5834 - DNA, 17 bp, Artificial sequence
  Synthesized sequence
ctggccgccgacctgcg

SEQ ID NO: 5835 - DNA, 17 bp, Artificial sequence
  Synthesized sequence
ctggcgcagcaattcga

SEQ ID NO: 5836 - DNA, 17 bp, Artificial sequence
  Synthesized sequence
gtggcggcggcgttcct

SEQ ID NO: 5837 - DNA, 17 bp, Artificial sequence
  Synthesized sequence
ctggaacccaaggcgca

SEQ ID NO: 5838 - DNA, 17 bp, Artificial sequence
  Synthesized sequence
ctggcatctccgtgcct

SEQ ID NO: 5839 - DNA, 17 bp, Artificial sequence
  Synthesized sequence
ctcgcgcaggcctggca

SEQ ID NO: 5840 - DNA, 17 bp, Artificial sequence
  Synthesized sequence
ttggaacgattctaggc

SEQ ID NO: 5841 - DNA, 17 bp, Artificial sequence
  Synthesized sequence
ttggcatcctaatgaca

SEQ ID NO: 5842 - DNA, 17 bp, Artificial sequence
  Synthesized sequence
ctgcgacgagcatttct

SEQ ID NO: 5843 - DNA, 17 bp, Artificial sequence
  Synthesized sequence
gtggtgcgtcggatgcc

SEQ ID NO: 5844 - DNA, 17 bp, Artificial sequence
  Synthesized sequence
gtggtgggcgatctgct

SEQ ID NO: 5845 - DNA, 17 bp, Artificial sequence
  Synthesized sequence
ctgggtgaccttctgct

SEQ ID NO: 5846 - DNA, 17 bp, Artificial sequence
  Synthesized sequence
gtcgcccggcgctggcg

SEQ ID NO: 5847 - DNA, 17 bp, Artificial sequence
  Synthesized sequence
acggcatcatccgtgcc

SEQ ID NO: 5848 - DNA, 17 bp, Artificial sequence
  Synthesized sequence
ctggctcgatctgcgcc

SEQ ID NO: 5849 - DNA, 17 bp, Artificial sequence
  Synthesized sequence
aaggtagagtcattgcc

SEQ ID NO: 5850 - DNA, 17 bp, Artificial sequence
  Synthesized sequence
caggtaggcatggtgca

SEQ ID NO: 5851 - DNA, 17 bp, Artificial sequence
  Synthesized sequence
ctgaccccggtctcgca

SEQ ID NO: 5852 - DNA, 17 bp, Artificial sequence
  Synthesized sequence
atggccggcctgatgaa

SEQ ID NO: 5853 - DNA, 17 bp, Artificial sequence
  Synthesized sequence
atggccaagctcctgtt

SEQ ID NO: 5854 - DNA, 17 bp, Artificial sequence
  Synthesized sequence
atcgccggcatcctgct

SEQ ID NO: 5855 - DNA, 17 bp, Artificial sequence
  Synthesized sequence
ctggacagcgcgctgct

SEQ ID NO: 5856 - DNA, 17 bp, Artificial sequence
  Synthesized sequence
caggcatcaaactggcg

SEQ ID NO: 5857 - DNA, 17 bp, Artificial sequence
  Synthesized sequence
gtcgcacaaccagggca

SEQ ID NO: 5858 - DNA, 17 bp, Artificial sequence
  Synthesized sequence
ccggcatcccaactgcc

SEQ ID NO: 5859 - DNA, 17 bp, Artificial sequence
  Synthesized sequence
ctggcccgcgagacgcc

SEQ ID NO: 5860 - DNA, 17 bp, Artificial sequence
  Synthesized sequence
gttgcccggctatttcg

SEQ ID NO: 5861 - DNA, 17 bp, Artificial sequence
  Synthesized sequence
ggcgcacggcgcatgcc

SEQ ID NO: 5862 - DNA, 17 bp, Artificial sequence
  Synthesized sequence
atggctttcgcgttgga

SEQ ID NO: 5863 - DNA, 17 bp, Artificial sequence
  Synthesized sequence
gtgccaaggtcctggcc

SEQ ID NO: 5864 - DNA, 17 bp, Artificial sequence
  Synthesized sequence
gtgggactctatccgct

SEQ ID NO: 5865 - DNA, 17 bp, Artificial sequence
  Synthesized sequence
ctggcatgggtcaagga

SEQ ID NO: 5866 - DNA, 17 bp, Artificial sequence
  Synthesized sequence
acggcagcctgatggct

SEQ ID NO: 5867 - DNA, 17 bp, Artificial sequence
  Synthesized sequence
atgaccctggtctcgct

SEQ ID NO: 5868 - DNA, 17 bp, Artificial sequence
  Synthesized sequence
ctggcacgaatgactcc

SEQ ID NO: 5869 - DNA, 17 bp, Artificial sequence
  Synthesized sequence
cgggcttcccccttgcg

SEQ ID NO: 5870 - DNA, 17 bp, Artificial sequence
  Synthesized sequence
ttggcatccgcttcgaa

SEQ ID NO: 5871 - DNA, 17 bp, Artificial sequence
  Synthesized sequence
ctggccctggaagagca

SEQ ID NO: 5872 - DNA, 17 bp, Artificial sequence
  Synthesized sequence
tcggcgcgctgcgtgcc

SEQ ID NO: 5873 - DNA, 17 bp, Artificial sequence
  Synthesized sequence
gtggaagcgcggatgcg

SEQ ID NO: 5874 - DNA, 17 bp, Artificial sequence
  Synthesized sequence
gtggagccgcgcatgcg

SEQ ID NO: 5875 - DNA, 17 bp, Artificial sequence
  Synthesized sequence
ttggagctgctggtgcg

SEQ ID NO: 5876 - DNA, 17 bp, Artificial sequence
  Synthesized sequence
ctggaacgcaccatggc

SEQ ID NO: 5877 - DNA, 17 bp, Artificial sequence
  Synthesized sequence
gcggcacacgcgctact

SEQ ID NO: 5878 - DNA, 17 bp, Artificial sequence
  Synthesized sequence
ctggaactggccatgga

SEQ ID NO: 5879 - DNA, 17 bp, Artificial sequence
  Synthesized sequence
ctggtacgggcggtggg

SEQ ID NO: 5880 - DNA, 17 bp, Artificial sequence
  Synthesized sequence
ctggagcgggccttccg

SEQ ID NO: 5881 - DNA, 17 bp, Artificial sequence
  Synthesized sequence
atcccactggccttgcg

SEQ ID NO: 5882 - DNA, 17 bp, Artificial sequence
  Synthesized sequence
ctggtcctgcacctgcc

SEQ ID NO: 5883 - DNA, 17 bp, Artificial sequence
  Synthesized sequence
gtggcaaccgccgtgta

SEQ ID NO: 5884 - DNA, 17 bp, Artificial sequence
  Synthesized sequence
ccggcgcgcgactcgcg

SEQ ID NO: 5885 - DNA, 17 bp, Artificial sequence
  Synthesized sequence
gcggaactcggcctgca

SEQ ID NO: 5886 - DNA, 17 bp, Artificial sequence
  Synthesized sequence
ctggccctggcggcgct

SEQ ID NO: 5887 - DNA, 17 bp, Artificial sequence
  Synthesized sequence
gtgacgcgccgtctgcg

SEQ ID NO: 5888 - DNA, 17 bp, Artificial sequence
  Synthesized sequence
atggaaggcatggtggt

SEQ ID NO: 5889 - DNA, 17 bp, Artificial sequence
  Synthesized sequence
gtagcgcggccgatgcc

SEQ ID NO: 5890 - DNA, 17 bp, Artificial sequence
  Synthesized sequence
ctcgaccatcagttgca

SEQ ID NO: 5891 - DNA, 17 bp, Artificial sequence
  Synthesized sequence
gtagcccggccctggcc

SEQ ID NO: 5892 - DNA, 17 bp, Artificial sequence
  Synthesized sequence
ctggacgacgagttgcc

SEQ ID NO: 5893 - DNA, 17 bp, Artificial sequence
  Synthesized sequence
atggcgcgcgacgagcg

SEQ ID NO: 5894 - DNA, 17 bp, Artificial sequence
  Synthesized sequence
ctggccctggccgtcct

SEQ ID NO: 5895 - DNA, 17 bp, Artificial sequence
  Synthesized sequence
ctggtctcgcccctgca

SEQ ID NO: 5896 - DNA, 17 bp, Artificial sequence
  Synthesized sequence
atgggccgatgatagcg

SEQ ID NO: 5897 - DNA, 17 bp, Artificial sequence
  Synthesized sequence
ctggcgcatgcgctgat

SEQ ID NO: 5898 - DNA, 17 bp, Artificial sequence
  Synthesized sequence
ccgtcacgacccgtgcg

SEQ ID NO: 5899 - DNA, 17 bp, Artificial sequence
  Synthesized sequence
ctggaacagcctgggcc

SEQ ID NO: 5900 - DNA, 17 bp, Artificial sequence
  Synthesized sequence
atgccaccgtgctttcc

SEQ ID NO: 5901 - DNA, 17 bp, Artificial sequence
  Synthesized sequence
atggcggccgggtcgct

SEQ ID NO: 5902 - DNA, 17 bp, Artificial sequence
  Synthesized sequence
ctggccataccgctgcg

SEQ ID NO: 5903 - DNA, 17 bp, Artificial sequence
  Synthesized sequence
gttgcacctgcaatgcg

SEQ ID NO: 5904 - DNA, 17 bp, Artificial sequence
  Synthesized sequence
atggcgcgcttctatcg

SEQ ID NO: 5905 - DNA, 17 bp, Artificial sequence
  Synthesized sequence
atggcgcgcttctatcg

SEQ ID NO: 5906 - DNA, 17 bp, Artificial sequence
  Synthesized sequence
ctggcgcgcaacgtggc

SEQ ID NO: 5907 - DNA, 17 bp, Artificial sequence
  Synthesized sequence
ttgatacattgcctgct

SEQ ID NO: 5908 - DNA, 17 bp, Artificial sequence
  Synthesized sequence
tatgcccatcagttgct

SEQ ID NO: 5909 - DNA, 17 bp, Artificial sequence
  Synthesized sequence
ctcgaatgcctctggca

SEQ ID NO: 5910 - DNA, 17 bp, Artificial sequence
  Synthesized sequence
ctgcaaggcttcctgct

SEQ ID NO: 5911 - DNA, 17 bp, Artificial sequence
  Synthesized sequence
ctggcccgctgcctggc

SEQ ID NO: 5912 - DNA, 17 bp, Artificial sequence
  Synthesized sequence
cgggcgcccccctggca

SEQ ID NO: 5913 - DNA, 17 bp, Artificial sequence
  Synthesized sequence
gcggcgcgaccttcgcc

SEQ ID NO: 5914 - DNA, 17 bp, Artificial sequence
  Synthesized sequence
ctggttcgccagttggc

SEQ ID NO: 5915 - DNA, 17 bp, Artificial sequence
  Synthesized sequence
atgggaccggccgttct

SEQ ID NO: 5916 - DNA, 17 bp, Artificial sequence
  Synthesized sequence
ctgggtcttgccctgct

SEQ ID NO: 5917 - DNA, 17 bp, Artificial sequence
  Synthesized sequence
atagggcccatattgct

SEQ ID NO: 5918 - DNA, 17 bp, Artificial sequence
  Synthesized sequence
gaggggcgcgccttgcg

SEQ ID NO: 5919 - DNA, 17 bp, Artificial sequence
  Synthesized sequence
gaggggcgcgccttgcg

SEQ ID NO: 5920 - DNA, 17 bp, Artificial sequence
  Synthesized sequence
ctggatcctgtactgca

SEQ ID NO: 5921 - DNA, 17 bp, Artificial sequence
  Synthesized sequence
atcgcgcaggcggtgca

SEQ ID NO: 5922 - DNA, 17 bp, Artificial sequence
  Synthesized sequence
ttggctcgtccatgtca

SEQ ID NO: 5923 - DNA, 17 bp, Artificial sequence
  Synthesized sequence
ttgccacccaagttgtg

SEQ ID NO: 5924 - DNA, 17 bp, Artificial sequence
  Synthesized sequence
acggcaagcgagtggcc

SEQ ID NO: 5925 - DNA, 17 bp, Artificial sequence
  Synthesized sequence
ctggcgcaccacctggg

SEQ ID NO: 5926 - DNA, 17 bp, Artificial sequence
  Synthesized sequence
caggccagccgcctgca

SEQ ID NO: 5927 - DNA, 17 bp, Artificial sequence
  Synthesized sequence
gtggccaccaccatgcg

SEQ ID NO: 5928 - DNA, 17 bp, Artificial sequence
  Synthesized sequence
atggtacgagccatggc

SEQ ID NO: 5929 - DNA, 17 bp, Artificial sequence
  Synthesized sequence
ttggtcaggccgttgtt

SEQ ID NO: 5930 - DNA, 17 bp, Artificial sequence
  Synthesized sequence
gagccaccggtgctgct

SEQ ID NO: 5931 - DNA, 17 bp, Artificial sequence
  Synthesized sequence
cgggcactggtgctgaa

SEQ ID NO: 5932 - DNA, 17 bp, Artificial sequence
  Synthesized sequence
ctggcattccagcagcg

SEQ ID NO: 5933 - DNA, 17 bp, Artificial sequence
  Synthesized sequence
atggccgggcacgtgga

SEQ ID NO: 5934 - DNA, 17 bp, Artificial sequence
  Synthesized sequence
gtggaagcgacgatgcg

SEQ ID NO: 5935 - DNA, 17 bp, Artificial sequence
  Synthesized sequence
gaggaaaaatgcttgcc

SEQ ID NO: 5936 - DNA, 17 bp, Artificial sequence
  Synthesized sequence
gtggcggcgatctttcg

SEQ ID NO: 5937 - DNA, 17 bp, Artificial sequence
  Synthesized sequence
ctggggcacgatttcca

SEQ ID NO: 5938 - DNA, 17 bp, Artificial sequence
  Synthesized sequence
caggcccggcggttgtc

SEQ ID NO: 5939 - DNA, 17 bp, Artificial sequence
  Synthesized sequence
ctggccctggcgctggt

SEQ ID NO: 5940 - DNA, 17 bp, Artificial sequence
  Synthesized sequence
caggccggcaagctgct

SEQ ID NO: 5941 - DNA, 17 bp, Artificial sequence
  Synthesized sequence
ctggcgctgcgcatcca

SEQ ID NO: 5942 - DNA, 17 bp, Artificial sequence
  Synthesized sequence
ctggctggcctcgggca

SEQ ID NO: 5943 - DNA, 17 bp, Artificial sequence
  Synthesized sequence
gcggcgcgcgtgtcgcc

SEQ ID NO: 5944 - DNA, 17 bp, Artificial sequence
  Synthesized sequence
ctggctgcaattctgcc

SEQ ID NO: 5945 - DNA, 17 bp, Artificial sequence
  Synthesized sequence
atggcaacgagatcgga

SEQ ID NO: 5946 - DNA, 17 bp, Artificial sequence
  Synthesized sequence
ttcccacacttcctgct

SEQ ID NO: 5947 - DNA, 17 bp, Artificial sequence
  Synthesized sequence
ctggtggtgctcctgct

SEQ ID NO: 5948 - DNA, 17 bp, Artificial sequence
  Synthesized sequence
gtggcccgtttcatgac

SEQ ID NO: 5949 - DNA, 17 bp, Artificial sequence
  Synthesized sequence
ctggcggcgttctggcc

SEQ ID NO: 5950 - DNA, 17 bp, Artificial sequence
  Synthesized sequence
ctgctactggccctgct

SEQ ID NO: 5951 - DNA, 17 bp, Artificial sequence
  Synthesized sequence
ctgcaaggctggttgcg

SEQ ID NO: 5952 - DNA, 17 bp, Artificial sequence
  Synthesized sequence
gaggcgctggagctgca

SEQ ID NO: 5953 - DNA, 17 bp, Artificial sequence
  Synthesized sequence
atggctcgcagcctggc

SEQ ID NO: 5954 - DNA, 17 bp, Artificial sequence
  Synthesized sequence
gtggcgctggcggcgct

SEQ ID NO: 5955 - DNA, 17 bp, Artificial sequence
  Synthesized sequence
gcggaaagacctctgca

SEQ ID NO: 5956 - DNA, 17 bp, Artificial sequence
  Synthesized sequence
atgccaacgccttggca

SEQ ID NO: 5957 - DNA, 17 bp, Artificial sequence
  Synthesized sequence
ccggcaagccggttccg

SEQ ID NO: 5958 - DNA, 17 bp, Artificial sequence
  Synthesized sequence
gcggcgctcggcctgct

SEQ ID NO: 5959 - DNA, 17 bp, Artificial sequence
  Synthesized sequence
gtggcgccggcgctggt

SEQ ID NO: 5960 - DNA, 17 bp, Artificial sequence
  Synthesized sequence
gcggcctgccgcttgtt

SEQ ID NO: 5961 - DNA, 17 bp, Artificial sequence
  Synthesized sequence
ctggtcgaccgcctgct

SEQ ID NO: 5962 - DNA, 17 bp, Artificial sequence
  Synthesized sequence
acggcactcatctggat

SEQ ID NO: 5963 - DNA, 17 bp, Artificial sequence
  Synthesized sequence
ggggcatggcggcttct

SEQ ID NO: 5964 - DNA, 17 bp, Artificial sequence
  Synthesized sequence
ctggcccaggcccggcg

SEQ ID NO: 5965 - DNA, 17 bp, Artificial sequence
  Synthesized sequence
ctggcccaggcccggcg

SEQ ID NO: 5966 - DNA, 17 bp, Artificial sequence
  Synthesized sequence
gaggcgatcatcttgcg

SEQ ID NO: 5967 - DNA, 17 bp, Artificial sequence
  Synthesized sequence
tgggcatgcgtctcgat

SEQ ID NO: 5968 - DNA, 17 bp, Artificial sequence
  Synthesized sequence
ctggctcgccgaccgcc

SEQ ID NO: 5969 - DNA, 17 bp, Artificial sequence
  Synthesized sequence
ctcgctgcacagttgca

SEQ ID NO: 5970 - DNA, 17 bp, Artificial sequence
  Synthesized sequence
tagcgatggaccttgct

SEQ ID NO: 5971 - DNA, 17 bp, Artificial sequence
  Synthesized sequence
gcggcatcgagtatgcc

SEQ ID NO: 5972 - DNA, 17 bp, Artificial sequence
  Synthesized sequence
gtgccacccaggtagcg

SEQ ID NO: 5973 - DNA, 17 bp, Artificial sequence
  Synthesized sequence
cctgtatgcctgttgca

SEQ ID NO: 5974 - DNA, 17 bp, Artificial sequence
  Synthesized sequence
gttgcctgacgcatgca

SEQ ID NO: 5975 - DNA, 17 bp, Artificial sequence
  Synthesized sequence
ctcgccggcatcctgct

SEQ ID NO: 5976 - DNA, 17 bp, Artificial sequence
  Synthesized sequence
ttgacaacaaattggct

SEQ ID NO: 5977 - DNA, 17 bp, Artificial sequence
  Synthesized sequence
ctggaggaaaacctgct

SEQ ID NO: 5978 - DNA, 17 bp, Artificial sequence
  Synthesized sequence
gtggtggaaaccctgct

SEQ ID NO: 5979 - DNA, 17 bp, Artificial sequence
  Synthesized sequence
tcggcgaagtgattgcc

SEQ ID NO: 5980 - DNA, 17 bp, Artificial sequence
  Synthesized sequence
atggcgcgcgacaggcc

SEQ ID NO: 5981 - DNA, 17 bp, Artificial sequence
  Synthesized sequence
gtggtacgcgccctggc

SEQ ID NO: 5982 - DNA, 17 bp, Artificial sequence
  Synthesized sequence
gtggcgcgcggtttcga

SEQ ID NO: 5983 - DNA, 17 bp, Artificial sequence
  Synthesized sequence
ctgggcgagtccctgct

SEQ ID NO: 5984 - DNA, 17 bp, Artificial sequence
  Synthesized sequence
atggccctggaggagct

SEQ ID NO: 5985 - DNA, 17 bp, Artificial sequence
  Synthesized sequence
gtggcgcgccgcatggc

SEQ ID NO: 5986 - DNA, 17 bp, Artificial sequence
  Synthesized sequence
ctggaaagagccgcgct

SEQ ID NO: 5987 - DNA, 17 bp, Artificial sequence
  Synthesized sequence
gcggcatgggaccggca

SEQ ID NO: 5988 - DNA, 17 bp, Artificial sequence
  Synthesized sequence
ctggaagtgcgcgtgcc

SEQ ID NO: 5989 - DNA, 17 bp, Artificial sequence
  Synthesized sequence
ctggcctacctgctgaa

SEQ ID NO: 5990 - DNA, 17 bp, Artificial sequence
  Synthesized sequence
atcgcccagttgttcca

SEQ ID NO: 5991 - DNA, 17 bp, Artificial sequence
  Synthesized sequence
acgacacatgggttgcc

SEQ ID NO: 5992 - DNA, 17 bp, Artificial sequence
  Synthesized sequence
atggcagcatcctagtt

SEQ ID NO: 5993 - DNA, 17 bp, Artificial sequence
  Synthesized sequence
gcgggactcgttgtgca

SEQ ID NO: 5994 - DNA, 17 bp, Artificial sequence
  Synthesized sequence
ctggccctggagctgaa

SEQ ID NO: 5995 - DNA, 17 bp, Artificial sequence
  Synthesized sequence
gcggtgcgcctgctgct

SEQ ID NO: 5996 - DNA, 17 bp, Artificial sequence
  Synthesized sequence
gtcgcggtgcgattgca

SEQ ID NO: 5997 - DNA, 17 bp, Artificial sequence
  Synthesized sequence
cgggcacctgtattacg

SEQ ID NO: 5998 - DNA, 17 bp, Artificial sequence
  Synthesized sequence
atatcacgggtgttgga

SEQ ID NO: 5999 - DNA, 17 bp, Artificial sequence
  Synthesized sequence
ctggaatgccggcagca

SEQ ID NO: 6000 - DNA, 17 bp, Artificial sequence
  Synthesized sequence
ctggcgctggaggcgca

SEQ ID NO: 6001 - DNA, 17 bp, Artificial sequence
  Synthesized sequence
cggccagggcttctgct

SEQ ID NO: 6002 - DNA, 17 bp, Artificial sequence
  Synthesized sequence
gttgcaaggatcgggct

SEQ ID NO: 6003 - DNA, 17 bp, Artificial sequence
  Synthesized sequence
ctggcccgctgccggcc

SEQ ID NO: 6004 - DNA, 17 bp, Artificial sequence
  Synthesized sequence
ctggcgccctgcgtggt

SEQ ID NO: 6005 - DNA, 17 bp, Artificial sequence
  Synthesized sequence
ctggcggcgccgctgcg

SEQ ID NO: 6006 - DNA, 17 bp, Artificial sequence
  Synthesized sequence
gaggaactcgactcgct

SEQ ID NO: 6007 - DNA, 17 bp, Artificial sequence
  Synthesized sequence
gaggaactcgactcgct

SEQ ID NO: 6008 - DNA, 17 bp, Artificial sequence
  Synthesized sequence
cgggaaaggtcactgct

SEQ ID NO: 6009 - DNA, 17 bp, Artificial sequence
  Synthesized sequence
gcggcgggtctcatgca

SEQ ID NO: 6010 - DNA, 17 bp, Artificial sequence
  Synthesized sequence
gttgcaaggcgatggcc

SEQ ID NO: 6011 - DNA, 17 bp, Artificial sequence
  Synthesized sequence
ctagcaaggacttcgcc

SEQ ID NO: 6012 - DNA, 17 bp, Artificial sequence
  Synthesized sequence
ctggagcggatcgtcct

SEQ ID NO: 6013 - DNA, 17 bp, Artificial sequence
  Synthesized sequence
gcgtcgcggtccttgcg

SEQ ID NO: 6014 - DNA, 17 bp, Artificial sequence
  Synthesized sequence
gcggcgcgcacggtgcg

SEQ ID NO: 6015 - DNA, 17 bp, Artificial sequence
  Synthesized sequence
ctgggagggaacctgga

SEQ ID NO: 6016 - DNA, 17 bp, Artificial sequence
  Synthesized sequence
ttggaaagaagatttcc

SEQ ID NO: 6017 - DNA, 17 bp, Artificial sequence
  Synthesized sequence
ctggccatgggtttcct

SEQ ID NO: 6018 - DNA, 17 bp, Artificial sequence
  Synthesized sequence
ctgctcggcctgttgct

SEQ ID NO: 6019 - DNA, 17 bp, Artificial sequence
  Synthesized sequence
gttgcaggaccttggcg

SEQ ID NO: 6020 - DNA, 17 bp, Artificial sequence
  Synthesized sequence
ctcggcctcctgttgca

SEQ ID NO: 6021 - DNA, 17 bp, Artificial sequence
  Synthesized sequence
ttggatcggctaatgat

SEQ ID NO: 6022 - DNA, 17 bp, Artificial sequence
  Synthesized sequence
ctggaaggattgcagca

SEQ ID NO: 6023 - DNA, 17 bp, Artificial sequence
  Synthesized sequence
ttcggccaggcgttgca

SEQ ID NO: 6024 - DNA, 17 bp, Artificial sequence
  Synthesized sequence
gcggcgctggcgatgct

SEQ ID NO: 6025 - DNA, 17 bp, Artificial sequence
  Synthesized sequence
ccggcaggcacatcgcc

SEQ ID NO: 6026 - DNA, 17 bp, Artificial sequence
  Synthesized sequence
ttcgaaccgcgctggct

SEQ ID NO: 6027 - DNA, 17 bp, Artificial sequence
  Synthesized sequence
ctggtactgacggtcct

SEQ ID NO: 6028 - DNA, 17 bp, Artificial sequence
  Synthesized sequence
atggcattcaacaggcg

SEQ ID NO: 6029 - DNA, 17 bp, Artificial sequence
  Synthesized sequence
ctgggccggaggttgtc

SEQ ID NO: 6030 - DNA, 17 bp, Artificial sequence
  Synthesized sequence
ctggaatggtactccca

SEQ ID NO: 6031 - DNA, 17 bp, Artificial sequence
  Synthesized sequence
gggacgcatctgttgct

SEQ ID NO: 6032 - DNA, 17 bp, Artificial sequence
  Synthesized sequence
ttggatcgaatcaggct

SEQ ID NO: 6033 - DNA, 17 bp, Artificial sequence
  Synthesized sequence
attgcactgctactgaa

SEQ ID NO: 6034 - DNA, 17 bp, Artificial sequence
  Synthesized sequence
ctggaagtcaaattgta

SEQ ID NO: 6035 - DNA, 17 bp, Artificial sequence
  Synthesized sequence
tcggcaggtccttagcg

SEQ ID NO: 6036 - DNA, 17 bp, Artificial sequence
  Synthesized sequence
cgggcgcggacatggcg

SEQ ID NO: 6037 - DNA, 17 bp, Artificial sequence
  Synthesized sequence
atggcaccctgatcgac

SEQ ID NO: 6038 - DNA, 17 bp, Artificial sequence
  Synthesized sequence
atggtgccggtgctgcg

SEQ ID NO: 6039 - DNA, 17 bp, Artificial sequence
  Synthesized sequence
ggcgcgcagcggttgca

SEQ ID NO: 6040 - DNA, 17 bp, Artificial sequence
  Synthesized sequence
atggctccaaaactgat

SEQ ID NO: 6041 - DNA, 17 bp, Artificial sequence
  Synthesized sequence
gtggccctgtcgctgtt

SEQ ID NO: 6042 - DNA, 17 bp, Artificial sequence
  Synthesized sequence
ctggccctgctgttcaa

SEQ ID NO: 6043 - DNA, 17 bp, Artificial sequence
  Synthesized sequence
gaggaccgcttcgtgct

SEQ ID NO: 6044 - DNA, 17 bp, Artificial sequence
  Synthesized sequence
ctgggccagccgtcgcg

SEQ ID NO: 6045 - DNA, 17 bp, Artificial sequence
  Synthesized sequence
acggcaagctggtcgcg

SEQ ID NO: 6046 - DNA, 17 bp, Artificial sequence
  Synthesized sequence
gaggaaggccgcctgct

SEQ ID NO: 6047 - DNA, 17 bp, Artificial sequence
  Synthesized sequence
gtggtcagcgcgctgct

SEQ ID NO: 6048 - DNA, 17 bp, Artificial sequence
  Synthesized sequence
tcggcgccatcctggct

SEQ ID NO: 6049 - DNA, 17 bp, Artificial sequence
  Synthesized sequence
gaggccctggcctggct

SEQ ID NO: 6050 - DNA, 17 bp, Artificial sequence
  Synthesized sequence
tcggcctgcgccgtgca

SEQ ID NO: 6051 - DNA, 17 bp, Artificial sequence
  Synthesized sequence
ctggaacaccccttcga

SEQ ID NO: 6052 - DNA, 17 bp, Artificial sequence
  Synthesized sequence
ggggcctggaccttcca

SEQ ID NO: 6053 - DNA, 17 bp, Artificial sequence
  Synthesized sequence
ccggcgcggacatcgcc

SEQ ID NO: 6054 - DNA, 17 bp, Artificial sequence
  Synthesized sequence
atggtgcgccacccgct

SEQ ID NO: 6055 - DNA, 17 bp, Artificial sequence
  Synthesized sequence
ctggcaggaaggcttcc

SEQ ID NO: 6056 - DNA, 17 bp, Artificial sequence
  Synthesized sequence
tgggagcggcgcctgct

SEQ ID NO: 6057 - DNA, 17 bp, Artificial sequence
  Synthesized sequence
gtggagtggcgcctgcg

SEQ ID NO: 6058 - DNA, 17 bp, Artificial sequence
  Synthesized sequence
caggcacgccgcctggg

SEQ ID NO: 6059 - DNA, 17 bp, Artificial sequence
  Synthesized sequence
gaggagcgcttcctgct

SEQ ID NO: 6060 - DNA, 17 bp, Artificial sequence
  Synthesized sequence
ctggcgtacctggtgat

SEQ ID NO: 6061 - DNA, 17 bp, Artificial sequence
  Synthesized sequence
gtgacccggccatcgcg

SEQ ID NO: 6062 - DNA, 17 bp, Artificial sequence
  Synthesized sequence
ctgacgatcggcttgct

SEQ ID NO: 6063 - DNA, 17 bp, Artificial sequence
  Synthesized sequence
ttggaggggtggatgca

SEQ ID NO: 6064 - DNA, 17 bp, Artificial sequence
  Synthesized sequence
ctggcaaagggcctggc

SEQ ID NO: 6065 - DNA, 17 bp, Artificial sequence
  Synthesized sequence
ctggggcgctattcgcc

SEQ ID NO: 6066 - DNA, 17 bp, Artificial sequence
  Synthesized sequence
ctggcccgctgcctggc

SEQ ID NO: 6067 - DNA, 17 bp, Artificial sequence
  Synthesized sequence
tcgccacgcggctggca

SEQ ID NO: 6068 - DNA, 17 bp, Artificial sequence
  Synthesized sequence
ctggcgcgcctcttcgg

SEQ ID NO: 6069 - DNA, 17 bp, Artificial sequence
  Synthesized sequence
acggcaagctggtggcg

SEQ ID NO: 6070 - DNA, 17 bp, Artificial sequence
  Synthesized sequence
ctggcaacagcggagca

SEQ ID NO: 6071 - DNA, 17 bp, Artificial sequence
  Synthesized sequence
gcggcatcggtgtggcg

SEQ ID NO: 6072 - DNA, 17 bp, Artificial sequence
  Synthesized sequence
ctggcgcaacgcccgcg

SEQ ID NO: 6073 - DNA, 17 bp, Artificial sequence
  Synthesized sequence
ccggcgcgatcggtgcc

SEQ ID NO: 6074 - DNA, 17 bp, Artificial sequence
  Synthesized sequence
agggctggcgctttgcc

SEQ ID NO: 6075 - DNA, 17 bp, Artificial sequence
  Synthesized sequence
ctggcgcgcaccgagcc

SEQ ID NO: 6076 - DNA, 17 bp, Artificial sequence
  Synthesized sequence
ctggtcctgcaactgcc

SEQ ID NO: 6077 - DNA, 17 bp, Artificial sequence
  Synthesized sequence
ctggaaatccgcctgcg

SEQ ID NO: 6078 - DNA, 17 bp, Artificial sequence
  Synthesized sequence
ctggcacctcgctgacc

SEQ ID NO: 6079 - DNA, 17 bp, Artificial sequence
  Synthesized sequence
ctggaactcgccacgct

SEQ ID NO: 6080 - DNA, 17 bp, Artificial sequence
  Synthesized sequence
ctggcgcgagggccgcc

SEQ ID NO: 6081 - DNA, 17 bp, Artificial sequence
  Synthesized sequence
tgggcacggccttcgag

SEQ ID NO: 6082 - DNA, 17 bp, Artificial sequence
  Synthesized sequence
ctggcgcaggctttcgt

SEQ ID NO: 6083 - DNA, 17 bp, Artificial sequence
  Synthesized sequence
agcgcaagcgccttgcg

SEQ ID NO: 6084 - DNA, 17 bp, Artificial sequence
  Synthesized sequence
ctggtcagccagtcgct

SEQ ID NO: 6085 - DNA, 17 bp, Artificial sequence
  Synthesized sequence
ctggccggtatcctgtt

SEQ ID NO: 6086 - DNA, 17 bp, Artificial sequence
  Synthesized sequence
ccggatcgccggttgcc

SEQ ID NO: 6087 - DNA, 17 bp, Artificial sequence
  Synthesized sequence
ctgagacttgatttgcg

SEQ ID NO: 6088 - DNA, 17 bp, Artificial sequence
  Synthesized sequence
atgggaaggaaggggct

SEQ ID NO: 6089 - DNA, 17 bp, Artificial sequence
  Synthesized sequence
ttggacaggctcatgcg

SEQ ID NO: 6090 - DNA, 17 bp, Artificial sequence
  Synthesized sequence
ctggcatatctatcgtg

SEQ ID NO: 6091 - DNA, 17 bp, Artificial sequence
  Synthesized sequence
ctggccagcctggtgga

SEQ ID NO: 6092 - DNA, 17 bp, Artificial sequence
  Synthesized sequence
atggaaccacgcctaca

SEQ ID NO: 6093 - DNA, 17 bp, Artificial sequence
  Synthesized sequence
ctgggaccagccgcgca

SEQ ID NO: 6094 - DNA, 17 bp, Artificial sequence
  Synthesized sequence
gcggcacgggctgggcg

SEQ ID NO: 6095 - DNA, 17 bp, Artificial sequence
  Synthesized sequence
gcggcacgggctgggcg

SEQ ID NO: 6096 - DNA, 17 bp, Artificial sequence
  Synthesized sequence
gtggcacactccaggga

SEQ ID NO: 6097 - DNA, 17 bp, Artificial sequence
  Synthesized sequence
atcgccgggctgtcgct

SEQ ID NO: 6098 - DNA, 17 bp, Artificial sequence
  Synthesized sequence
atgccgcgcgcgttcct

SEQ ID NO: 6099 - DNA, 17 bp, Artificial sequence
  Synthesized sequence
ctggtacgcgcactggg

SEQ ID NO: 6100 - DNA, 17 bp, Artificial sequence
  Synthesized sequence
ctggcgatagacctgcg

SEQ ID NO: 6101 - DNA, 17 bp, Artificial sequence
  Synthesized sequence
ttcgatcaggcgttgca

SEQ ID NO: 6102 - DNA, 17 bp, Artificial sequence
  Synthesized sequence
atggcgtgctccaggca

SEQ ID NO: 6103 - DNA, 17 bp, Artificial sequence
  Synthesized sequence
atgggaccgaagctgga

SEQ ID NO: 6104 - DNA, 17 bp, Artificial sequence
  Synthesized sequence
caggcgcaggatttcca

SEQ ID NO: 6105 - DNA, 17 bp, Artificial sequence
  Synthesized sequence
ctgtccagggcgttgcc

SEQ ID NO: 6106 - DNA, 17 bp, Artificial sequence
  Synthesized sequence
cggccactgctgatgct

SEQ ID NO: 6107 - DNA, 17 bp, Artificial sequence
  Synthesized sequence
ctgccgcgtgcgctgca

SEQ ID NO: 6108 - DNA, 17 bp, Artificial sequence
  Synthesized sequence
ctcgcacaacctgagca

SEQ ID NO: 6109 - DNA, 17 bp, Artificial sequence
  Synthesized sequence
tcggcgcgctgctcgcg

SEQ ID NO: 6110 - DNA, 17 bp, Artificial sequence
  Synthesized sequence
gtggcagaagtactggg

SEQ ID NO: 6111 - DNA, 17 bp, Artificial sequence
  Synthesized sequence
gccgcactgaccctgct

SEQ ID NO: 6112 - DNA, 17 bp, Artificial sequence
  Synthesized sequence
ctagcacagcgcctcca

SEQ ID NO: 6113 - DNA, 17 bp, Artificial sequence
  Synthesized sequence
gcggcacggtgaccgcg

SEQ ID NO: 6114 - DNA, 17 bp, Artificial sequence
  Synthesized sequence
ttggtaccgatgtccca

SEQ ID NO: 6115 - DNA, 17 bp, Artificial sequence
  Synthesized sequence
agcgcacgatgtttgaa

SEQ ID NO: 6116 - DNA, 17 bp, Artificial sequence
  Synthesized sequence
tttgcacgaatattcga

SEQ ID NO: 6117 - DNA, 17 bp, Artificial sequence
  Synthesized sequence
ctggttgccgttttgcg

SEQ ID NO: 6118 - DNA, 17 bp, Artificial sequence
  Synthesized sequence
atggaccgggtcctgtt

SEQ ID NO: 6119 - DNA, 17 bp, Artificial sequence
  Synthesized sequence
ctggcgcgacggatccg

SEQ ID NO: 6120 - DNA, 17 bp, Artificial sequence
  Synthesized sequence
ttggaaagccttgggca

SEQ ID NO: 6121 - DNA, 17 bp, Artificial sequence
  Synthesized sequence
ctgaccctgaccatgca

SEQ ID NO: 6122 - DNA, 17 bp, Artificial sequence
  Synthesized sequence
cgggcatgcctgatgga

SEQ ID NO: 6123 - DNA, 17 bp, Artificial sequence
  Synthesized sequence
gttgccgccaccttgca

SEQ ID NO: 6124 - DNA, 17 bp, Artificial sequence
  Synthesized sequence
tcggcgcgccgttggcg

SEQ ID NO: 6125 - DNA, 17 bp, Artificial sequence
  Synthesized sequence
gaggcacacaaggagca

SEQ ID NO: 6126 - DNA, 17 bp, Artificial sequence
  Synthesized sequence
cagggacgcgatctgcg

SEQ ID NO: 6127 - DNA, 17 bp, Artificial sequence
  Synthesized sequence
ccggcacggctgttcgg

SEQ ID NO: 6128 - DNA, 17 bp, Artificial sequence
  Synthesized sequence
tcggcccgtagcctgcg

SEQ ID NO: 6129 - DNA, 17 bp, Artificial sequence
  Synthesized sequence
tcggcccgtagcctgcg

SEQ ID NO: 6130 - DNA, 17 bp, Artificial sequence
  Synthesized sequence
ttggcaagaatcgcgaa

SEQ ID NO: 6131 - DNA, 17 bp, Artificial sequence
  Synthesized sequence
gtggcgctattgtcgat

SEQ ID NO: 6132 - DNA, 17 bp, Artificial sequence
  Synthesized sequence
ctggcatccccatgtca

SEQ ID NO: 6133 - DNA, 17 bp, Artificial sequence
  Synthesized sequence
cagggccgcttcctgct

SEQ ID NO: 6134 - DNA, 17 bp, Artificial sequence
  Synthesized sequence
gtgaaaccctacctgct

SEQ ID NO: 6135 - DNA, 17 bp, Artificial sequence
  Synthesized sequence
ctgctctgccaattgct

SEQ ID NO: 6136 - DNA, 17 bp, Artificial sequence
  Synthesized sequence
ctgactaatgctttgct

SEQ ID NO: 6137 - DNA, 17 bp, Artificial sequence
  Synthesized sequence
atggcgcaggtcaagcg

SEQ ID NO: 6138 - DNA, 17 bp, Artificial sequence
  Synthesized sequence
atggcgcaggtcaagcg

SEQ ID NO: 6139 - DNA, 17 bp, Artificial sequence
  Synthesized sequence
aattcacgggccttgca

SEQ ID NO: 6140 - DNA, 17 bp, Artificial sequence
  Synthesized sequence
cgtccacgaaacttgca

SEQ ID NO: 6141 - DNA, 17 bp, Artificial sequence
  Synthesized sequence
ctggcgctatcgaggct

SEQ ID NO: 6142 - DNA, 17 bp, Artificial sequence
  Synthesized sequence
gtagcggaactgttgcc

SEQ ID NO: 6143 - DNA, 17 bp, Artificial sequence
  Synthesized sequence
ctggctcaacagtgcct

SEQ ID NO: 6144 - DNA, 17 bp, Artificial sequence
  Synthesized sequence
ctggtgcgcaggttgtg

SEQ ID NO: 6145 - DNA, 17 bp, Artificial sequence
  Synthesized sequence
gcaggatgagtcttgct

SEQ ID NO: 6146 - DNA, 17 bp, Artificial sequence
  Synthesized sequence
ctgcgcctggacttgct

SEQ ID NO: 6147 - DNA, 17 bp, Artificial sequence
  Synthesized sequence
ctggagggacgctcgca

SEQ ID NO: 6148 - DNA, 17 bp, Artificial sequence
  Synthesized sequence
ctggtacgccgggtggg

SEQ ID NO: 6149 - DNA, 17 bp, Artificial sequence
  Synthesized sequence
atgtctcgcgccttact

SEQ ID NO: 6150 - DNA, 17 bp, Artificial sequence
  Synthesized sequence
cgggaaaccgcattgca

SEQ ID NO: 6151 - DNA, 17 bp, Artificial sequence
  Synthesized sequence
cagtcattgtcattgca

SEQ ID NO: 6152 - DNA, 17 bp, Artificial sequence
  Synthesized sequence
ccggcgcggcgatggcc

SEQ ID NO: 6153 - DNA, 17 bp, Artificial sequence
  Synthesized sequence
ttcgccgacttcttgcc

SEQ ID NO: 6154 - DNA, 17 bp, Artificial sequence
  Synthesized sequence
atcgctcgcctgctgcc

SEQ ID NO: 6155 - DNA, 17 bp, Artificial sequence
  Synthesized sequence
ctggcgctcgtcctcca

SEQ ID NO: 6156 - DNA, 17 bp, Artificial sequence
  Synthesized sequence
atgcgacgccccctgcc

SEQ ID NO: 6157 - DNA, 17 bp, Artificial sequence
  Synthesized sequence
ctgtcgcgcaccctgcg

SEQ ID NO: 6158 - DNA, 17 bp, Artificial sequence
  Synthesized sequence
gtggatcaggacgtgcc

SEQ ID NO: 6159 - DNA, 17 bp, Artificial sequence
  Synthesized sequence
gtagaacgctccctgcg

SEQ ID NO: 6160 - DNA, 17 bp, Artificial sequence
  Synthesized sequence
ctggaaggacgccagct

SEQ ID NO: 6161 - DNA, 17 bp, Artificial sequence
  Synthesized sequence
ctggaaggacgccagct

SEQ ID NO: 6162 - DNA, 17 bp, Artificial sequence
  Synthesized sequence
ctggcggcggccctgcc

SEQ ID NO: 6163 - DNA, 17 bp, Artificial sequence
  Synthesized sequence
caggcaagggcatttcc

SEQ ID NO: 6164 - DNA, 17 bp, Artificial sequence
  Synthesized sequence
ggggaaatgcccttgcc

SEQ ID NO: 6165 - DNA, 17 bp, Artificial sequence
  Synthesized sequence
cagggaccgatcgtgcg

SEQ ID NO: 6166 - DNA, 17 bp, Artificial sequence
  Synthesized sequence
atggtcttttttttgcc

SEQ ID NO: 6167 - DNA, 17 bp, Artificial sequence
  Synthesized sequence
ctgataggagaattgcc

SEQ ID NO: 6168 - DNA, 17 bp, Artificial sequence
  Synthesized sequence
ttggcttgatgtgcgct

SEQ ID NO: 6169 - DNA, 17 bp, Artificial sequence
  Synthesized sequence
ctggcaggtcagctacg

SEQ ID NO: 6170 - DNA, 17 bp, Artificial sequence
  Synthesized sequence
tcgggtccggacttgca

SEQ ID NO: 6171 - DNA, 17 bp, Artificial sequence
  Synthesized sequence
cttgctggagaattgcg

SEQ ID NO: 6172 - DNA, 17 bp, Artificial sequence
  Synthesized sequence
ctggcgcgcagcctggg

SEQ ID NO: 6173 - DNA, 17 bp, Artificial sequence
  Synthesized sequence
ctggccgagctcatcct

SEQ ID NO: 6174 - DNA, 17 bp, Artificial sequence
  Synthesized sequence
ctggaaatgagcctgcc

SEQ ID NO: 6175 - DNA, 17 bp, Artificial sequence
  Synthesized sequence
tcggtacgcggctggcg

SEQ ID NO: 6176 - DNA, 17 bp, Artificial sequence
  Synthesized sequence
ggcgcacgcctgctgcg

SEQ ID NO: 6177 - DNA, 17 bp, Artificial sequence
  Synthesized sequence
acggtccgcttcgtgct

SEQ ID NO: 6178 - DNA, 17 bp, Artificial sequence
  Synthesized sequence
ctggtacaccagcggcg

SEQ ID NO: 6179 - DNA, 17 bp, Artificial sequence
  Synthesized sequence
ctcccgcgcaagttgca

SEQ ID NO: 6180 - DNA, 17 bp, Artificial sequence
  Synthesized sequence
cgggcgggcttcgtgca

SEQ ID NO: 6181 - DNA, 17 bp, Artificial sequence
  Synthesized sequence
gtgggcaagcaactgct

SEQ ID NO: 6182 - DNA, 17 bp, Artificial sequence
  Synthesized sequence
ccgcaacggccgttgcg

SEQ ID NO: 6183 - DNA, 17 bp, Artificial sequence
  Synthesized sequence
gtggtcgagcaactgca

SEQ ID NO: 6184 - DNA, 17 bp, Artificial sequence
  Synthesized sequence
gcggcggggttgtggct

SEQ ID NO: 6185 - DNA, 17 bp, Artificial sequence
  Synthesized sequence
gttccacggtgttcgct

SEQ ID NO: 6186 - DNA, 17 bp, Artificial sequence
  Synthesized sequence
gtggcccgaccacttcc

SEQ ID NO: 6187 - DNA, 17 bp, Artificial sequence
  Synthesized sequence
aaggcaccgcgaacgca

SEQ ID NO: 6188 - DNA, 17 bp, Artificial sequence
  Synthesized sequence
gtcgaactgcgcctgca

SEQ ID NO: 6189 - DNA, 17 bp, Artificial sequence
  Synthesized sequence
atggcgcgggtgtagtc

SEQ ID NO: 6190 - DNA, 17 bp, Artificial sequence
  Synthesized sequence
atggcgacgaaggtgcg

SEQ ID NO: 6191 - DNA, 17 bp, Artificial sequence
  Synthesized sequence
atggcgacgaaggtgcg

SEQ ID NO: 6192 - DNA, 17 bp, Artificial sequence
  Synthesized sequence
tcggcacgggccaggcg

SEQ ID NO: 6193 - DNA, 17 bp, Artificial sequence
  Synthesized sequence
ccggcaacatgctggca

SEQ ID NO: 6194 - DNA, 17 bp, Artificial sequence
  Synthesized sequence
cgggcacgccctcggcg

SEQ ID NO: 6195 - DNA, 17 bp, Artificial sequence
  Synthesized sequence
ctggtgggcgccgtgct

SEQ ID NO: 6196 - DNA, 17 bp, Artificial sequence
  Synthesized sequence
ctgggacaggtcatgac

SEQ ID NO: 6197 - DNA, 17 bp, Artificial sequence
  Synthesized sequence
ctgccgcgcagcctgcg

SEQ ID NO: 6198 - DNA, 17 bp, Artificial sequence
  Synthesized sequence
gtggcctggagctgggt

SEQ ID NO: 6199 - DNA, 17 bp, Artificial sequence
  Synthesized sequence
cgggcacggtggcggcg

SEQ ID NO: 6200 - DNA, 17 bp, Artificial sequence
  Synthesized sequence
aaggtccgttccttgcg

SEQ ID NO: 6201 - DNA, 17 bp, Artificial sequence
  Synthesized sequence
gaggcgcagccgatgcg

SEQ ID NO: 6202 - DNA, 17 bp, Artificial sequence
  Synthesized sequence
gtggcgacgccgatgcg

SEQ ID NO: 6203 - DNA, 17 bp, Artificial sequence
  Synthesized sequence
gaggcgctcccctggct

SEQ ID NO: 6204 - DNA, 17 bp, Artificial sequence
  Synthesized sequence
ctcgaccgccagttgcg

SEQ ID NO: 6205 - DNA, 17 bp, Artificial sequence
  Synthesized sequence
ctcggacagaccttcct

SEQ ID NO: 6206 - DNA, 17 bp, Artificial sequence
  Synthesized sequence
aaggcgcgcctgttggc

SEQ ID NO: 6207 - DNA, 17 bp, Artificial sequence
  Synthesized sequence
gggccacgatttctgcg

SEQ ID NO: 6208 - DNA, 17 bp, Artificial sequence
  Synthesized sequence
ccggcacgacccatgtc

SEQ ID NO: 6209 - DNA, 17 bp, Artificial sequence
  Synthesized sequence
atggccctcgccgcgct

SEQ ID NO: 6210 - DNA, 17 bp, Artificial sequence
  Synthesized sequence
gccgccccgccgttgct

SEQ ID NO: 6211 - DNA, 17 bp, Artificial sequence
  Synthesized sequence
tcggcgcgccgctggcc

SEQ ID NO: 6212 - DNA, 17 bp, Artificial sequence
  Synthesized sequence
ttcgcctggatttcgca

SEQ ID NO: 6213 - DNA, 17 bp, Artificial sequence
  Synthesized sequence
ctggcgtaattcctgaa

SEQ ID NO: 6214 - DNA, 17 bp, Artificial sequence
  Synthesized sequence
ctggcgcgccgacagcg

SEQ ID NO: 6215 - DNA, 17 bp, Artificial sequence
  Synthesized sequence
cggggacaagacttcca

SEQ ID NO: 6216 - DNA, 17 bp, Artificial sequence
  Synthesized sequence
ctggccgctgcctggct

SEQ ID NO: 6217 - DNA, 17 bp, Artificial sequence
  Synthesized sequence
ctggtcggcgaggtgct

SEQ ID NO: 6218 - DNA, 17 bp, Artificial sequence
  Synthesized sequence
tggtcacgattcctgcc

SEQ ID NO: 6219 - DNA, 17 bp, Artificial sequence
  Synthesized sequence
gaggctccgatcttcca

SEQ ID NO: 6220 - DNA, 17 bp, Artificial sequence
  Synthesized sequence
gaggacgagctgttgct

SEQ ID NO: 6221 - DNA, 17 bp, Artificial sequence
  Synthesized sequence
gaggacgagctgttgct

SEQ ID NO: 6222 - DNA, 17 bp, Artificial sequence
  Synthesized sequence
ctggatctgttcctgcg

SEQ ID NO: 6223 - DNA, 17 bp, Artificial sequence
  Synthesized sequence
tggggaccgtgctggct

SEQ ID NO: 6224 - DNA, 17 bp, Artificial sequence
  Synthesized sequence
gtggcgccacttttttt

SEQ ID NO: 6225 - DNA, 17 bp, Artificial sequence
  Synthesized sequence
gaggaaccgttcatgcg

SEQ ID NO: 6226 - DNA, 17 bp, Artificial sequence
  Synthesized sequence
ctggccgggcacatgga

SEQ ID NO: 6227 - DNA, 17 bp, Artificial sequence
  Synthesized sequence
ctgagccgttcgttgca

SEQ ID NO: 6228 - DNA, 17 bp, Artificial sequence
  Synthesized sequence
ctggagcgggtcgggct

SEQ ID NO: 6229 - DNA, 17 bp, Artificial sequence
  Synthesized sequence
ctggcgtgcggcgcgca

SEQ ID NO: 6230 - DNA, 17 bp, Artificial sequence
  Synthesized sequence
atgatcggcctgttgct

SEQ ID NO: 6231 - DNA, 17 bp, Artificial sequence
  Synthesized sequence
cttgcccggcgaatgcc

SEQ ID NO: 6232 - DNA, 17 bp, Artificial sequence
  Synthesized sequence
ccggaaggcatgatgct

SEQ ID NO: 6233 - DNA, 17 bp, Artificial sequence
  Synthesized sequence
ctgccgactcaattgct

SEQ ID NO: 6234 - DNA, 17 bp, Artificial sequence
  Synthesized sequence
gcggcaagcgcttcgcc

SEQ ID NO: 6235 - DNA, 17 bp, Artificial sequence
  Synthesized sequence
ctgaaacgtatgtttca

SEQ ID NO: 6236 - DNA, 17 bp, Artificial sequence
  Synthesized sequence
ttggcggggcgtcagct

SEQ ID NO: 6237 - DNA, 17 bp, Artificial sequence
  Synthesized sequence
ctggatgggctgttaca

SEQ ID NO: 6238 - DNA, 17 bp, Artificial sequence
  Synthesized sequence
ctggcctgcgctccgca

SEQ ID NO: 6239 - DNA, 17 bp, Artificial sequence
  Synthesized sequence
agggcgcgcattttacg

SEQ ID NO: 6240 - DNA, 17 bp, Artificial sequence
  Synthesized sequence
ctggaaggacgcaagct

SEQ ID NO: 6241 - DNA, 17 bp, Artificial sequence
  Synthesized sequence
gtggcaacggagtggaa

SEQ ID NO: 6242 - DNA, 17 bp, Artificial sequence
  Synthesized sequence
gtggcaggcgggctacg

SEQ ID NO: 6243 - DNA, 17 bp, Artificial sequence
  Synthesized sequence
tcggaacctttctggct

SEQ ID NO: 6244 - DNA, 17 bp, Artificial sequence
  Synthesized sequence
aaggcaggagcgtggcg

SEQ ID NO: 6245 - DNA, 17 bp, Artificial sequence
  Synthesized sequence
tcggcacccttcattct

SEQ ID NO: 6246 - DNA, 17 bp, Artificial sequence
  Synthesized sequence
ttgctacgcgagttgga

SEQ ID NO: 6247 - DNA, 17 bp, Artificial sequence
  Synthesized sequence
ttgctacgcgagttgga

SEQ ID NO: 6248 - DNA, 17 bp, Artificial sequence
  Synthesized sequence
atggcgtcatgtgtgcg

SEQ ID NO: 6249 - DNA, 17 bp, Artificial sequence
  Synthesized sequence
ctgacccgccgcctgcg

SEQ ID NO: 6250 - DNA, 17 bp, Artificial sequence
  Synthesized sequence
ttggaaccggtagtcca

SEQ ID NO: 6251 - DNA, 17 bp, Artificial sequence
  Synthesized sequence
gaggaatacctggtgca

SEQ ID NO: 6252 - DNA, 17 bp, Artificial sequence
  Synthesized sequence
caggaccgggtcgtgca

SEQ ID NO: 6253 - DNA, 17 bp, Artificial sequence
  Synthesized sequence
ctggaacaacaccagcc

SEQ ID NO: 6254 - DNA, 17 bp, Artificial sequence
  Synthesized sequence
cagccacgtggcctgca

SEQ ID NO: 6255 - DNA, 17 bp, Artificial sequence
  Synthesized sequence
gcggcgtgcacctcgct

SEQ ID NO: 6256 - DNA, 17 bp, Artificial sequence
  Synthesized sequence
ctggaacgacgtgttcg

SEQ ID NO: 6257 - DNA, 17 bp, Artificial sequence
  Synthesized sequence
aaggaactctgcctgca

SEQ ID NO: 6258 - DNA, 17 bp, Artificial sequence
  Synthesized sequence
gtgtcgccgaacatgca

SEQ ID NO: 6259 - DNA, 17 bp, Artificial sequence
  Synthesized sequence
gagccacggcatctgcg

SEQ ID NO: 6260 - DNA, 17 bp, Artificial sequence
  Synthesized sequence
atggcccgcgacatggg

SEQ ID NO: 6261 - DNA, 17 bp, Artificial sequence
  Synthesized sequence
cagtcacacctattgat

SEQ ID NO: 6262 - DNA, 17 bp, Artificial sequence
  Synthesized sequence
ctggcgcgcctcttcgg

SEQ ID NO: 6263 - DNA, 17 bp, Artificial sequence
  Synthesized sequence
gcggcgctgatcctgcg

SEQ ID NO: 6264 - DNA, 17 bp, Artificial sequence
  Synthesized sequence
ctggcaggcggagcgcc

SEQ ID NO: 6265 - DNA, 17 bp, Artificial sequence
  Synthesized sequence
tgggcaagtaaagtgcc

SEQ ID NO: 6266 - DNA, 17 bp, Artificial sequence
  Synthesized sequence
ctgcggcgcatgttgcg

SEQ ID NO: 6267 - DNA, 17 bp, Artificial sequence
  Synthesized sequence
ctggcgcgatgtcggcc

SEQ ID NO: 6268 - DNA, 17 bp, Artificial sequence
  Synthesized sequence
atggcgccctgcctgat

SEQ ID NO: 6269 - DNA, 17 bp, Artificial sequence
  Synthesized sequence
ccggcacgttgctggga

SEQ ID NO: 6270 - DNA, 17 bp, Artificial sequence
  Synthesized sequence
ctggcaagccaatgtcc

SEQ ID NO: 6271 - DNA, 17 bp, Artificial sequence
  Synthesized sequence
gcggcacctggttggcg

SEQ ID NO: 6272 - DNA, 17 bp, Artificial sequence
  Synthesized sequence
gggggcgggtttttgca

SEQ ID NO: 6273 - DNA, 17 bp, Artificial sequence
  Synthesized sequence
ctgggattttccctgcg

SEQ ID NO: 6274 - DNA, 17 bp, Artificial sequence
  Synthesized sequence
ctggcaagggcttcggc

SEQ ID NO: 6275 - DNA, 17 bp, Artificial sequence
  Synthesized sequence
ttggctgcttcggtgct

SEQ ID NO: 6276 - DNA, 17 bp, Artificial sequence
  Synthesized sequence
ttggaacatgaggtgtt

SEQ ID NO: 6277 - DNA, 17 bp, Artificial sequence
  Synthesized sequence
tcgtcgcggcgcttgcg

SEQ ID NO: 6278 - DNA, 17 bp, Artificial sequence
  Synthesized sequence
atggcctgaacgaggca

SEQ ID NO: 6279 - DNA, 17 bp, Artificial sequence
  Synthesized sequence
gcggcgcgccagtcgcc

SEQ ID NO: 6280 - DNA, 17 bp, Artificial sequence
  Synthesized sequence
ctggcctgtagccagct

SEQ ID NO: 6281 - DNA, 17 bp, Artificial sequence
  Synthesized sequence
ttcccattctttttgca

SEQ ID NO: 6282 - DNA, 17 bp, Artificial sequence
  Synthesized sequence
ctggcgcgcagcgagcg

SEQ ID NO: 6283 - DNA, 17 bp, Artificial sequence
  Synthesized sequence
cttgaacggcaatcgcc

SEQ ID NO: 6284 - DNA, 17 bp, Artificial sequence
  Synthesized sequence
atggcagtgtttgcgcg

SEQ ID NO: 6285 - DNA, 17 bp, Artificial sequence
  Synthesized sequence
ctggcggcgcaggtgcg

SEQ ID NO: 6286 - DNA, 17 bp, Artificial sequence
  Synthesized sequence
atggcaggcgcgcagcc

SEQ ID NO: 6287 - DNA, 17 bp, Artificial sequence
  Synthesized sequence
ctggaactccccatgaa

SEQ ID NO: 6288 - DNA, 17 bp, Artificial sequence
  Synthesized sequence
atggtggaactggtgca

SEQ ID NO: 6289 - DNA, 17 bp, Artificial sequence
  Synthesized sequence
ctgaccccgccgctgca

SEQ ID NO: 6290 - DNA, 17 bp, Artificial sequence
  Synthesized sequence
ctggcccgcgccctggc

SEQ ID NO: 6291 - DNA, 17 bp, Artificial sequence
  Synthesized sequence
ccggcacggcgaaggcc

SEQ ID NO: 6292 - DNA, 17 bp, Artificial sequence
  Synthesized sequence
gtggcgctttcatttcc

SEQ ID NO: 6293 - DNA, 17 bp, Artificial sequence
  Synthesized sequence
attgaatcttcgttgct

SEQ ID NO: 6294 - DNA, 17 bp, Artificial sequence
  Synthesized sequence
gtggcgctgatgttcat

SEQ ID NO: 6295 - DNA, 17 bp, Artificial sequence
  Synthesized sequence
gttgcacaacccctcca

SEQ ID NO: 6296 - DNA, 17 bp, Artificial sequence
  Synthesized sequence
cgggcgcgcttcttccc

SEQ ID NO: 6297 - DNA, 17 bp, Artificial sequence
  Synthesized sequence
gtagcacggctggttcg

SEQ ID NO: 6298 - DNA, 17 bp, Artificial sequence
  Synthesized sequence
ctggaacaggttcagcc

SEQ ID NO: 6299 - DNA, 17 bp, Artificial sequence
  Synthesized sequence
ggcgcaagccgcttgcc

SEQ ID NO: 6300 - DNA, 17 bp, Artificial sequence
  Synthesized sequence
tcggggcgtccgttgcg

SEQ ID NO: 6301 - DNA, 17 bp, Artificial sequence
  Synthesized sequence
ctggcctcgcgttcgcc

SEQ ID NO: 6302 - DNA, 17 bp, Artificial sequence
  Synthesized sequence
atgtcggtctccttgca

SEQ ID NO: 6303 - DNA, 17 bp, Artificial sequence
  Synthesized sequence
ctggctatactgctgcc

SEQ ID NO: 6304 - DNA, 17 bp, Artificial sequence
  Synthesized sequence
cttgtaaggcagatgct

SEQ ID NO: 6305 - DNA, 17 bp, Artificial sequence
  Synthesized sequence
acggcgctcgccatgct

SEQ ID NO: 6306 - DNA, 17 bp, Artificial sequence
  Synthesized sequence
ccggctcggatattccc

SEQ ID NO: 6307 - DNA, 17 bp, Artificial sequence
  Synthesized sequence
tttgcaaatcatttgta

SEQ ID NO: 6308 - DNA, 17 bp, Artificial sequence
  Synthesized sequence
caggccagggcactgct

SEQ ID NO: 6309 - DNA, 17 bp, Artificial sequence
  Synthesized sequence
tttgcccgggtcttccg

SEQ ID NO: 6310 - DNA, 17 bp, Artificial sequence
  Synthesized sequence
gaggcctggccgttcct

SEQ ID NO: 6311 - DNA, 17 bp, Artificial sequence
  Synthesized sequence
caggtcggcaagttgct

SEQ ID NO: 6312 - DNA, 17 bp, Artificial sequence
  Synthesized sequence
ctggggggcgccctgct

SEQ ID NO: 6313 - DNA, 17 bp, Artificial sequence
  Synthesized sequence
ctgtcacaacccatcca

SEQ ID NO: 6314 - DNA, 17 bp, Artificial sequence
  Synthesized sequence
cgggtgcgcttcctgca

SEQ ID NO: 6315 - DNA, 17 bp, Artificial sequence
  Synthesized sequence
tatgcacagttgttcct

SEQ ID NO: 6316 - DNA, 17 bp, Artificial sequence
  Synthesized sequence
cgggcaccgctatgcct

SEQ ID NO: 6317 - DNA, 17 bp, Artificial sequence
  Synthesized sequence
accgctcaccggttgct

SEQ ID NO: 6318 - DNA, 17 bp, Artificial sequence
  Synthesized sequence
caggtgcacttcttgcc

SEQ ID NO: 6319 - DNA, 17 bp, Artificial sequence
  Synthesized sequence
agggcaggtatgttgtg

SEQ ID NO: 6320 - DNA, 17 bp, Artificial sequence
  Synthesized sequence
ccggcagagctgttacc

SEQ ID NO: 6321 - DNA, 17 bp, Artificial sequence
  Synthesized sequence
ctgcaaggctgattgcg

SEQ ID NO: 6322 - DNA, 17 bp, Artificial sequence
  Synthesized sequence
cgggcctggcggttgaa

SEQ ID NO: 6323 - DNA, 17 bp, Artificial sequence
  Synthesized sequence
ggggcttcttcgttgca

SEQ ID NO: 6324 - DNA, 17 bp, Artificial sequence
  Synthesized sequence
gtggcattacctgggcg

SEQ ID NO: 6325 - DNA, 17 bp, Artificial sequence
  Synthesized sequence
gttgccagcatcctgct

SEQ ID NO: 6326 - DNA, 17 bp, Artificial sequence
  Synthesized sequence
ggggtattgctcctgca

SEQ ID NO: 6327 - DNA, 17 bp, Artificial sequence
  Synthesized sequence
atggctctctccaggct

SEQ ID NO: 6328 - DNA, 17 bp, Artificial sequence
  Synthesized sequence
cttgcagggtaatcgcg

SEQ ID NO: 6329 - DNA, 17 bp, Artificial sequence
  Synthesized sequence
taggcacctacgtcgcc

SEQ ID NO: 6330 - DNA, 17 bp, Artificial sequence
  Synthesized sequence
cagggcctggagttgca

SEQ ID NO: 6331 - DNA, 17 bp, Artificial sequence
  Synthesized sequence
ctggacggcgaactgct

SEQ ID NO: 6332 - DNA, 17 bp, Artificial sequence
  Synthesized sequence
ttgtgacgtccttcgca

SEQ ID NO: 6333 - DNA, 17 bp, Artificial sequence
  Synthesized sequence
tcggccctcggcatgct

SEQ ID NO: 6334 - DNA, 17 bp, Artificial sequence
  Synthesized sequence
ctggcgccgacaaggca

SEQ ID NO: 6335 - DNA, 17 bp, Artificial sequence
  Synthesized sequence
ccggaacgccggtggcg

SEQ ID NO: 6336 - DNA, 17 bp, Artificial sequence
  Synthesized sequence
cgggcacctacgttccg

SEQ ID NO: 6337 - DNA, 17 bp, Artificial sequence
  Synthesized sequence
ctggcgagcctggagca

SEQ ID NO: 6338 - DNA, 17 bp, Artificial sequence
  Synthesized sequence
gcggcacggcgctggtg

SEQ ID NO: 6339 - DNA, 17 bp, Artificial sequence
  Synthesized sequence
gcggcacggcgctggtg

SEQ ID NO: 6340 - DNA, 17 bp, Artificial sequence
  Synthesized sequence
ccggaactcagcctgca

SEQ ID NO: 6341 - DNA, 17 bp, Artificial sequence
  Synthesized sequence
gtgccagcaacctcgct

SEQ ID NO: 6342 - DNA, 17 bp, Artificial sequence
  Synthesized sequence
ctggcgctggccgagca

SEQ ID NO: 6343 - DNA, 17 bp, Artificial sequence
  Synthesized sequence
ctggcaatgtactacca

SEQ ID NO: 6344 - DNA, 17 bp, Artificial sequence
  Synthesized sequence
ctggtgctgcgcctgcc

SEQ ID NO: 6345 - DNA, 17 bp, Artificial sequence
  Synthesized sequence
ctggcgggagtgacgct

SEQ ID NO: 6346 - DNA, 17 bp, Artificial sequence
  Synthesized sequence
gcggcacgggccgcgcc

SEQ ID NO: 6347 - DNA, 17 bp, Artificial sequence
  Synthesized sequence
gcggcacgggccgcgcc

SEQ ID NO: 6348 - DNA, 17 bp, Artificial sequence
  Synthesized sequence
gtggaagggcgcctgga

SEQ ID NO: 6349 - DNA, 17 bp, Artificial sequence
  Synthesized sequence
ctggcgaagcgatttcg

SEQ ID NO: 6350 - DNA, 17 bp, Artificial sequence
  Synthesized sequence
gtgggacgaggagcgcg

SEQ ID NO: 6351 - DNA, 17 bp, Artificial sequence
  Synthesized sequence
ctggcgctgggcatgaa

SEQ ID NO: 6352 - DNA, 17 bp, Artificial sequence
  Synthesized sequence
gcggcaggccgatggcc

SEQ ID NO: 6353 - DNA, 17 bp, Artificial sequence
  Synthesized sequence
atgggaaaggccttggc

SEQ ID NO: 6354 - DNA, 17 bp, Artificial sequence
  Synthesized sequence
tgggaaaggccttggct

SEQ ID NO: 6355 - DNA, 17 bp, Artificial sequence
  Synthesized sequence
ctggctcgaacgcggcc

SEQ ID NO: 6356 - DNA, 17 bp, Artificial sequence
  Synthesized sequence
ctggaacgctcgcagcc

SEQ ID NO: 6357 - DNA, 17 bp, Artificial sequence
  Synthesized sequence
ccggcactggtgatgtt

SEQ ID NO: 6358 - DNA, 17 bp, Artificial sequence
  Synthesized sequence
ctggccctgtgccttca

SEQ ID NO: 6359 - DNA, 17 bp, Artificial sequence
  Synthesized sequence
tcggcgcgctcgatgcg

SEQ ID NO: 6360 - DNA, 17 bp, Artificial sequence
  Synthesized sequence
gtggaactggggcggct

SEQ ID NO: 6361 - DNA, 17 bp, Artificial sequence
  Synthesized sequence
ctggagccgagcttcca

SEQ ID NO: 6362 - DNA, 17 bp, Artificial sequence
  Synthesized sequence
gtggtgaagttctggct

SEQ ID NO: 6363 - DNA, 17 bp, Artificial sequence
  Synthesized sequence
atgccgcacatattcct

SEQ ID NO: 6364 - DNA, 17 bp, Artificial sequence
  Synthesized sequence
atggcctggggcctgga

SEQ ID NO: 6365 - DNA, 17 bp, Artificial sequence
  Synthesized sequence
ccggcacagcatccgcg

SEQ ID NO: 6366 - DNA, 17 bp, Artificial sequence
  Synthesized sequence
gtgggcctagacttcct

SEQ ID NO: 6367 - DNA, 17 bp, Artificial sequence
  Synthesized sequence
aaggccgcggtcttgcc

SEQ ID NO: 6368 - DNA, 17 bp, Artificial sequence
  Synthesized sequence
atagcctaacggttgcc

SEQ ID NO: 6369 - DNA, 17 bp, Artificial sequence
  Synthesized sequence
aaggcccggatcctggt

SEQ ID NO: 6370 - DNA, 17 bp, Artificial sequence
  Synthesized sequence
ctgggcgtgccgttgcg

SEQ ID NO: 6371 - DNA, 17 bp, Artificial sequence
  Synthesized sequence
tcggcaagcgcctggcc

SEQ ID NO: 6372 - DNA, 17 bp, Artificial sequence
  Synthesized sequence
ttcgcgccgaagctgct

SEQ ID NO: 6373 - DNA, 17 bp, Artificial sequence
  Synthesized sequence
ctgccgccggccctgct

SEQ ID NO: 6374 - DNA, 17 bp, Artificial sequence
  Synthesized sequence
ctgccgccggccctgct

SEQ ID NO: 6375 - DNA, 17 bp, Artificial sequence
  Synthesized sequence
gtggtccgagcgttggg

SEQ ID NO: 6376 - DNA, 17 bp, Artificial sequence
  Synthesized sequence
gcggcaaaccgctggcg

SEQ ID NO: 6377 - DNA, 17 bp, Artificial sequence
  Synthesized sequence
gaggctctcgccatgct

SEQ ID NO: 6378 - DNA, 17 bp, Artificial sequence
  Synthesized sequence
ctggcccgcgagctggg

SEQ ID NO: 6379 - DNA, 17 bp, Artificial sequence
  Synthesized sequence
tcggagcgggtcatgct

SEQ ID NO: 6380 - DNA, 17 bp, Artificial sequence
  Synthesized sequence
aaggccgctgcattgct

SEQ ID NO: 6381 - DNA, 17 bp, Artificial sequence
  Synthesized sequence
ctggtacgggcactggc

SEQ ID NO: 6382 - DNA, 17 bp, Artificial sequence
  Synthesized sequence
gtggccggcaaccggct

SEQ ID NO: 6383 - DNA, 17 bp, Artificial sequence
  Synthesized sequence
ctggcccagctctggtc

SEQ ID NO: 6384 - DNA, 17 bp, Artificial sequence
  Synthesized sequence
caggccagcgacctgct

SEQ ID NO: 6385 - DNA, 17 bp, Artificial sequence
  Synthesized sequence
tcggtacacgagttgaa

SEQ ID NO: 6386 - DNA, 17 bp, Artificial sequence
  Synthesized sequence
ctggcgcgccgacggcc

SEQ ID NO: 6387 - DNA, 17 bp, Artificial sequence
  Synthesized sequence
ctggcggcgagcctgcc

SEQ ID NO: 6388 - DNA, 17 bp, Artificial sequence
  Synthesized sequence
agggcgcgcaattcgcg

SEQ ID NO: 6389 - DNA, 17 bp, Artificial sequence
  Synthesized sequence
gtggcgaaggccttggc

SEQ ID NO: 6390 - DNA, 17 bp, Artificial sequence
  Synthesized sequence
cagggaagtgccttgcc

SEQ ID NO: 6391 - DNA, 17 bp, Artificial sequence
  Synthesized sequence
aaggcggcgtttttgcc

SEQ ID NO: 6392 - DNA, 17 bp, Artificial sequence
  Synthesized sequence
ctggccctggcctcggt

SEQ ID NO: 6393 - DNA, 17 bp, Artificial sequence
  Synthesized sequence
atcgcgcgccatctgcc

SEQ ID NO: 6394 - DNA, 17 bp, Artificial sequence
  Synthesized sequence
ctggtaggccaggcgca

SEQ ID NO: 6395 - DNA, 17 bp, Artificial sequence
  Synthesized sequence
ctggccatagggttggt

SEQ ID NO: 6396 - DNA, 17 bp, Artificial sequence
  Synthesized sequence
gttgcacggtacgggcg

SEQ ID NO: 6397 - DNA, 17 bp, Artificial sequence
  Synthesized sequence
acggcctgcgccgtgca

SEQ ID NO: 6398 - DNA, 17 bp, Artificial sequence
  Synthesized sequence
ctgggagggtaccagca

SEQ ID NO: 6399 - DNA, 17 bp, Artificial sequence
  Synthesized sequence
ctgggtcaggcgtttca

SEQ ID NO: 6400 - DNA, 17 bp, Artificial sequence
  Synthesized sequence
gcggcgcaggcgttcct

SEQ ID NO: 6401 - DNA, 17 bp, Artificial sequence
  Synthesized sequence
gcggcaaggcgcaggct

SEQ ID NO: 6402 - DNA, 17 bp, Artificial sequence
  Synthesized sequence
ctggcgctacagatgga

SEQ ID NO: 6403 - DNA, 17 bp, Artificial sequence
  Synthesized sequence
cgggcgcgaagaatgcc

SEQ ID NO: 6404 - DNA, 17 bp, Artificial sequence
  Synthesized sequence
gtggctcctgctttgtc

SEQ ID NO: 6405 - DNA, 17 bp, Artificial sequence
  Synthesized sequence
ttggcaacgcttctggc

SEQ ID NO: 6406 - DNA, 17 bp, Artificial sequence
  Synthesized sequence
gtcgccctggtggtgca

SEQ ID NO: 6407 - DNA, 17 bp, Artificial sequence
  Synthesized sequence
ccggcacgcccaacgcc

SEQ ID NO: 6408 - DNA, 17 bp, Artificial sequence
  Synthesized sequence
tcgccacgaccgtttca

SEQ ID NO: 6409 - DNA, 17 bp, Artificial sequence
  Synthesized sequence
ttgaaacgcggttttct

SEQ ID NO: 6410 - DNA, 17 bp, Artificial sequence
  Synthesized sequence
tcggcatcgtcctcgcc

SEQ ID NO: 6411 - DNA, 17 bp, Artificial sequence
  Synthesized sequence
atggagggccaggtgca

SEQ ID NO: 6412 - DNA, 17 bp, Artificial sequence
  Synthesized sequence
ttgggaccagttgggca

SEQ ID NO: 6413 - DNA, 17 bp, Artificial sequence
  Synthesized sequence
gtgcgacggtccgtgcg

SEQ ID NO: 6414 - DNA, 17 bp, Artificial sequence
  Synthesized sequence
gtggcgaactgctggcg

SEQ ID NO: 6415 - DNA, 17 bp, Artificial sequence
  Synthesized sequence
ttggccggacgcctgtt

SEQ ID NO: 6416 - DNA, 17 bp, Artificial sequence
  Synthesized sequence
ctgccgctgacgctgct

SEQ ID NO: 6417 - DNA, 17 bp, Artificial sequence
  Synthesized sequence
gtggcagatgcgatcca

SEQ ID NO: 6418 - DNA, 17 bp, Artificial sequence
  Synthesized sequence
gtgtcgcaggctttgat

SEQ ID NO: 6419 - DNA, 17 bp, Artificial sequence
  Synthesized sequence
gtggtcgagcgcctgca

SEQ ID NO: 6420 - DNA, 17 bp, Artificial sequence
  Synthesized sequence
gcgccgcagtggttgct

SEQ ID NO: 6421 - DNA, 17 bp, Artificial sequence
  Synthesized sequence
ccggcaagttcctggcc

SEQ ID NO: 6422 - DNA, 17 bp, Artificial sequence
  Synthesized sequence
atggtggtggacttgcc

SEQ ID NO: 6423 - DNA, 17 bp, Artificial sequence
  Synthesized sequence
atggcccagcgcctgtc

SEQ ID NO: 6424 - DNA, 17 bp, Artificial sequence
  Synthesized sequence
atgcctcggccaatgcc

SEQ ID NO: 6425 - DNA, 17 bp, Artificial sequence
  Synthesized sequence
gcggcgccgtactggca

SEQ ID NO: 6426 - DNA, 17 bp, Artificial sequence
  Synthesized sequence
ctcgcccagtagttcct

SEQ ID NO: 6427 - DNA, 17 bp, Artificial sequence
  Synthesized sequence
atgccgcaggcctggct

SEQ ID NO: 6428 - DNA, 17 bp, Artificial sequence
  Synthesized sequence
gtggcctcaagctggcc

SEQ ID NO: 6429 - DNA, 17 bp, Artificial sequence
  Synthesized sequence
ctgacctggccgctgca

SEQ ID NO: 6430 - DNA, 17 bp, Artificial sequence
  Synthesized sequence
atggcacccgggtcggc

SEQ ID NO: 6431 - DNA, 17 bp, Artificial sequence
  Synthesized sequence
gtggcagtggcggtgga

SEQ ID NO: 6432 - DNA, 17 bp, Artificial sequence
  Synthesized sequence
gtggcgaacgggctgcg

SEQ ID NO: 6433 - DNA, 17 bp, Artificial sequence
  Synthesized sequence
agggaacgaccgttgag

SEQ ID NO: 6434 - DNA, 17 bp, Artificial sequence
  Synthesized sequence
acgcgacagtctttgca

SEQ ID NO: 6435 - DNA, 17 bp, Artificial sequence
  Synthesized sequence
gcggcatggcgaaggca

SEQ ID NO: 6436 - DNA, 17 bp, Artificial sequence
  Synthesized sequence
gcggcatggcgaaggca

SEQ ID NO: 6437 - DNA, 17 bp, Artificial sequence
  Synthesized sequence
ttggcactgagcaggat

SEQ ID NO: 6438 - DNA, 17 bp, Artificial sequence
  Synthesized sequence
ctgatacggctgttccg

SEQ ID NO: 6439 - DNA, 17 bp, Artificial sequence
  Synthesized sequence
ctggtgctcgcgtcgct

SEQ ID NO: 6440 - DNA, 17 bp, Artificial sequence
  Synthesized sequence
ctgtgccggccgttgcg

SEQ ID NO: 6441 - DNA, 17 bp, Artificial sequence
  Synthesized sequence
ctggagcggatcaagca

SEQ ID NO: 6442 - DNA, 17 bp, Artificial sequence
  Synthesized sequence
ctggccggcaacgtgat

SEQ ID NO: 6443 - DNA, 17 bp, Artificial sequence
  Synthesized sequence
ctggctcggtgtctggc

SEQ ID NO: 6444 - DNA, 17 bp, Artificial sequence
  Synthesized sequence
ttggccaagctggcgct

SEQ ID NO: 6445 - DNA, 17 bp, Artificial sequence
  Synthesized sequence
ctcgaacgctacctgcg

SEQ ID NO: 6446 - DNA, 17 bp, Artificial sequence
  Synthesized sequence
ctggatagccgctcgct

SEQ ID NO: 6447 - DNA, 17 bp, Artificial sequence
  Synthesized sequence
ggggctcgacgatcgcg

SEQ ID NO: 6448 - DNA, 17 bp, Artificial sequence
  Synthesized sequence
ccggcaggtcgctttcg

SEQ ID NO: 6449 - DNA, 17 bp, Artificial sequence
  Synthesized sequence
agggcaaggagattccc

SEQ ID NO: 6450 - DNA, 17 bp, Artificial sequence
  Synthesized sequence
agggcaaggagattccc

SEQ ID NO: 6451 - DNA, 17 bp, Artificial sequence
  Synthesized sequence
gtggccctgcgttcgat

SEQ ID NO: 6452 - DNA, 17 bp, Artificial sequence
  Synthesized sequence
atggaccaggcgctgcg

SEQ ID NO: 6453 - DNA, 17 bp, Artificial sequence
  Synthesized sequence
aatgcacggcctctgcg

SEQ ID NO: 6454 - DNA, 17 bp, Artificial sequence
  Synthesized sequence
ttgaaatgagtgctgca

SEQ ID NO: 6455 - DNA, 17 bp, Artificial sequence
  Synthesized sequence
gtgaccctgtcgctgct

SEQ ID NO: 6456 - DNA, 17 bp, Artificial sequence
  Synthesized sequence
atggcggcgccgatgcg

SEQ ID NO: 6457 - DNA, 17 bp, Artificial sequence
  Synthesized sequence
gaggcaggtcggtggcg

SEQ ID NO: 6458 - DNA, 17 bp, Artificial sequence
  Synthesized sequence
atggaccacccgatgcc

SEQ ID NO: 6459 - DNA, 17 bp, Artificial sequence
  Synthesized sequence
ctggctcttctgcggca

SEQ ID NO: 6460 - DNA, 17 bp, Artificial sequence
  Synthesized sequence
caggcaggcgtgttggc

SEQ ID NO: 6461 - DNA, 17 bp, Artificial sequence
  Synthesized sequence
ctggaagggcgcctgga

SEQ ID NO: 6462 - DNA, 17 bp, Artificial sequence
  Synthesized sequence
tgggcattcgtctcgcg

SEQ ID NO: 6463 - DNA, 17 bp, Artificial sequence
  Synthesized sequence
gaggaacgggactagcc

SEQ ID NO: 6464 - DNA, 17 bp, Artificial sequence
  Synthesized sequence
gtggcccgaggcctgtc

SEQ ID NO: 6465 - DNA, 17 bp, Artificial sequence
  Synthesized sequence
ctgggaagacagcagct

SEQ ID NO: 6466 - DNA, 17 bp, Artificial sequence
  Synthesized sequence
gtagaacctcggttgcc

SEQ ID NO: 6467 - DNA, 17 bp, Artificial sequence
  Synthesized sequence
atggcaaccgaggttct

SEQ ID NO: 6468 - DNA, 17 bp, Artificial sequence
  Synthesized sequence
ctggacgacgagttgcg

SEQ ID NO: 6469 - DNA, 17 bp, Artificial sequence
  Synthesized sequence
atggccagagtactgat

SEQ ID NO: 6470 - DNA, 17 bp, Artificial sequence
  Synthesized sequence
cttgcgcgaaaaatgcg

SEQ ID NO: 6471 - DNA, 17 bp, Artificial sequence
  Synthesized sequence
tatgcatgatggttgcc

SEQ ID NO: 6472 - DNA, 17 bp, Artificial sequence
  Synthesized sequence
gtggccgggcgtcagct

SEQ ID NO: 6473 - DNA, 17 bp, Artificial sequence
  Synthesized sequence
ctggagcgccagttgtc

SEQ ID NO: 6474 - DNA, 17 bp, Artificial sequence
  Synthesized sequence
ctggggcgatcatcgcc

SEQ ID NO: 6475 - DNA, 17 bp, Artificial sequence
  Synthesized sequence
cgggcgcgggacttccg

SEQ ID NO: 6476 - DNA, 17 bp, Artificial sequence
  Synthesized sequence
caggcaggctgatcgcg

SEQ ID NO: 6477 - DNA, 17 bp, Artificial sequence
  Synthesized sequence
gagggacggcgattgac

SEQ ID NO: 6478 - DNA, 17 bp, Artificial sequence
  Synthesized sequence
gcggagcgcggcttgcg

SEQ ID NO: 6479 - DNA, 17 bp, Artificial sequence
  Synthesized sequence
ttggttcaactctttcg

SEQ ID NO: 6480 - DNA, 17 bp, Artificial sequence
  Synthesized sequence
ctggcagtgtcttcgaa

SEQ ID NO: 6481 - DNA, 17 bp, Artificial sequence
  Synthesized sequence
ggggcctcattgttgcc

SEQ ID NO: 6482 - DNA, 17 bp, Artificial sequence
  Synthesized sequence
ctggtctacaagctgca

SEQ ID NO: 6483 - DNA, 17 bp, Artificial sequence
  Synthesized sequence
accgaacaaccattgca

SEQ ID NO: 6484 - DNA, 17 bp, Artificial sequence
  Synthesized sequence
atggtctggtacgtgcc

SEQ ID NO: 6485 - DNA, 17 bp, Artificial sequence
  Synthesized sequence
ctggagcggctgctgaa

SEQ ID NO: 6486 - DNA, 17 bp, Artificial sequence
  Synthesized sequence
ctggaacgcggcctgac

SEQ ID NO: 6487 - DNA, 17 bp, Artificial sequence
  Synthesized sequence
aaggaactgaccttggt

SEQ ID NO: 6488 - DNA, 17 bp, Artificial sequence
  Synthesized sequence
ttggccccgtgcgtcca

SEQ ID NO: 6489 - DNA, 17 bp, Artificial sequence
  Synthesized sequence
ctgccagccgccctgca

SEQ ID NO: 6490 - DNA, 17 bp, Artificial sequence
  Synthesized sequence
gcggtaggggaactgca

SEQ ID NO: 6491 - DNA, 17 bp, Artificial sequence
  Synthesized sequence
ctggccgggagcgagct

SEQ ID NO: 6492 - DNA, 17 bp, Artificial sequence
  Synthesized sequence
ctggaacaggtcatgac

SEQ ID NO: 6493 - DNA, 17 bp, Artificial sequence
  Synthesized sequence
ctggaacaggtcatgac

SEQ ID NO: 6494 - DNA, 17 bp, Artificial sequence
  Synthesized sequence
ctggctcgaacgacgcg

SEQ ID NO: 6495 - DNA, 17 bp, Artificial sequence
  Synthesized sequence
ctggagcggcacctggt

SEQ ID NO: 6496 - DNA, 17 bp, Artificial sequence
  Synthesized sequence
gtcgaatggcacttcct

SEQ ID NO: 6497 - DNA, 17 bp, Artificial sequence
  Synthesized sequence
atggcctgaggccttct

SEQ ID NO: 6498 - DNA, 17 bp, Artificial sequence
  Synthesized sequence
ctggcgctgggcatgaa

SEQ ID NO: 6499 - DNA, 17 bp, Artificial sequence
  Synthesized sequence
gtgccaccagcatcgcg

SEQ ID NO: 6500 - DNA, 17 bp, Artificial sequence
  Synthesized sequence
ctggcgcgcccgctggc

SEQ ID NO: 6501 - DNA, 17 bp, Artificial sequence
  Synthesized sequence
atggcaactcctcttca

SEQ ID NO: 6502 - DNA, 17 bp, Artificial sequence
  Synthesized sequence
ctgggacgggtatcggc

SEQ ID NO: 6503 - DNA, 17 bp, Artificial sequence
  Synthesized sequence
ttcgcccggccgatgcc

SEQ ID NO: 6504 - DNA, 17 bp, Artificial sequence
  Synthesized sequence
gcggcgctgacttcgct

SEQ ID NO: 6505 - DNA, 17 bp, Artificial sequence
  Synthesized sequence
agagcatagagcttgcc

SEQ ID NO: 6506 - DNA, 17 bp, Artificial sequence
  Synthesized sequence
atgacacggaacaggcg

SEQ ID NO: 6507 - DNA, 17 bp, Artificial sequence
  Synthesized sequence
atgacacggaacaggcg

SEQ ID NO: 6508 - DNA, 17 bp, Artificial sequence
  Synthesized sequence
cgggctgacccgttgcg

SEQ ID NO: 6509 - DNA, 17 bp, Artificial sequence
  Synthesized sequence
ctggcgcgcgagcggcc

SEQ ID NO: 6510 - DNA, 17 bp, Artificial sequence
  Synthesized sequence
gtgccgcgccgcctgcc

SEQ ID NO: 6511 - DNA, 17 bp, Artificial sequence
  Synthesized sequence
ctggaactggccgagca

SEQ ID NO: 6512 - DNA, 17 bp, Artificial sequence
  Synthesized sequence
ccggcacgcccgccgcc

SEQ ID NO: 6513 - DNA, 17 bp, Artificial sequence
  Synthesized sequence
gtggtccgccacccgct

SEQ ID NO: 6514 - DNA, 17 bp, Artificial sequence
  Synthesized sequence
ctggaacagcgcaagcc

SEQ ID NO: 6515 - DNA, 17 bp, Artificial sequence
  Synthesized sequence
ctggcgctgctcgagcg

SEQ ID NO: 6516 - DNA, 17 bp, Artificial sequence
  Synthesized sequence
ctgcaactggtggtgca

SEQ ID NO: 6517 - DNA, 17 bp, Artificial sequence
  Synthesized sequence
caggcctcgctgctgct

SEQ ID NO: 6518 - DNA, 17 bp, Artificial sequence
  Synthesized sequence
ccggcaccgatggtcct

SEQ ID NO: 6519 - DNA, 17 bp, Artificial sequence
  Synthesized sequence
ctggcgcgcgtgcagcc

SEQ ID NO: 6520 - DNA, 17 bp, Artificial sequence
  Synthesized sequence
gcggcgcgggcatcgcg

SEQ ID NO: 6521 - DNA, 17 bp, Artificial sequence
  Synthesized sequence
atggcgccgaagtcggt

SEQ ID NO: 6522 - DNA, 17 bp, Artificial sequence
  Synthesized sequence
atggaaggcctgctggt

SEQ ID NO: 6523 - DNA, 17 bp, Artificial sequence
  Synthesized sequence
acggcccgtccctcgcg

SEQ ID NO: 6524 - DNA, 17 bp, Artificial sequence
  Synthesized sequence
gcggaacaggacctgcg

SEQ ID NO: 6525 - DNA, 17 bp, Artificial sequence
  Synthesized sequence
ctggcgccgctgttcgt

SEQ ID NO: 6526 - DNA, 17 bp, Artificial sequence
  Synthesized sequence
ctgccgcgccgcctgcg

SEQ ID NO: 6527 - DNA, 17 bp, Artificial sequence
  Synthesized sequence
atcgcacgcccttccct

SEQ ID NO: 6528 - DNA, 17 bp, Artificial sequence
  Synthesized sequence
ctggaagaagtgttccg

SEQ ID NO: 6529 - DNA, 17 bp, Artificial sequence
  Synthesized sequence
ccggcaagttcctcgcg

SEQ ID NO: 6530 - DNA, 17 bp, Artificial sequence
  Synthesized sequence
atggaagcgacgctgcg

SEQ ID NO: 6531 - DNA, 17 bp, Artificial sequence
  Synthesized sequence
ctggcgcagcatgcgcc

SEQ ID NO: 6532 - DNA, 17 bp, Artificial sequence
  Synthesized sequence
tcgggacgaccatggcg

SEQ ID NO: 6533 - DNA, 17 bp, Artificial sequence
  Synthesized sequence
ccggcgcagccggtgcc

SEQ ID NO: 6534 - DNA, 17 bp, Artificial sequence
  Synthesized sequence
gtcgcgccggccatgct

SEQ ID NO: 6535 - DNA, 17 bp, Artificial sequence
  Synthesized sequence
atggcgcgcaaggcgcc

SEQ ID NO: 6536 - DNA, 17 bp, Artificial sequence
  Synthesized sequence
gtggcgcgcaactggtg

SEQ ID NO: 6537 - DNA, 17 bp, Artificial sequence
  Synthesized sequence
agggcgcgctgcatgcc

SEQ ID NO: 6538 - DNA, 17 bp, Artificial sequence
  Synthesized sequence
ctgatacaggcgtagct

SEQ ID NO: 6539 - DNA, 17 bp, Artificial sequence
  Synthesized sequence
atggtcgagccggtgct

SEQ ID NO: 6540 - DNA, 17 bp, Artificial sequence
  Synthesized sequence
gtggtcaccaccttgcg

SEQ ID NO: 6541 - DNA, 17 bp, Artificial sequence
  Synthesized sequence
cctgaacggcccttgcc

SEQ ID NO: 6542 - DNA, 17 bp, Artificial sequence
  Synthesized sequence
gcgtcacgccggttgtt

SEQ ID NO: 6543 - DNA, 17 bp, Artificial sequence
  Synthesized sequence
atggcaatactcatgtg

SEQ ID NO: 6544 - DNA, 17 bp, Artificial sequence
  Synthesized sequence
atggcgcgggactcccg

SEQ ID NO: 6545 - DNA, 17 bp, Artificial sequence
  Synthesized sequence
ctggtgcgcctggagct

SEQ ID NO: 6546 - DNA, 17 bp, Artificial sequence
  Synthesized sequence
gtagccaagcctttgcg

SEQ ID NO: 6547 - DNA, 17 bp, Artificial sequence
  Synthesized sequence
gaggccgagttcctgca

SEQ ID NO: 6548 - DNA, 17 bp, Artificial sequence
  Synthesized sequence
ctggccggcaacgcgct

SEQ ID NO: 6549 - DNA, 17 bp, Artificial sequence
  Synthesized sequence
agggccgaccatttgcc

SEQ ID NO: 6550 - DNA, 17 bp, Artificial sequence
  Synthesized sequence
caggcctaccgcgtgct

SEQ ID NO: 6551 - DNA, 17 bp, Artificial sequence
  Synthesized sequence
ctggcgcggctgttcgc

SEQ ID NO: 6552 - DNA, 17 bp, Artificial sequence
  Synthesized sequence
cggatacactgcttgca

SEQ ID NO: 6553 - DNA, 17 bp, Artificial sequence
  Synthesized sequence
ctggcgaccctggtgcc

SEQ ID NO: 6554 - DNA, 17 bp, Artificial sequence
  Synthesized sequence
gcagtacacgccttgct

SEQ ID NO: 6555 - DNA, 17 bp, Artificial sequence
  Synthesized sequence
ctgggcgaactgctgct

SEQ ID NO: 6556 - DNA, 17 bp, Artificial sequence
  Synthesized sequence
ctggtggggggaatgct

SEQ ID NO: 6557 - DNA, 17 bp, Artificial sequence
  Synthesized sequence
ttcgcgcaggcgctgca

SEQ ID NO: 6558 - DNA, 17 bp, Artificial sequence
  Synthesized sequence
ttgccgcaaatcctgcg

SEQ ID NO: 6559 - DNA, 17 bp, Artificial sequence
  Synthesized sequence
gcggtgaaggtcttgct

SEQ ID NO: 6560 - DNA, 17 bp, Artificial sequence
  Synthesized sequence
ctggcgcggtcgtcgag

SEQ ID NO: 6561 - DNA, 17 bp, Artificial sequence
  Synthesized sequence
ctggctatgatggtgcc

SEQ ID NO: 6562 - DNA, 17 bp, Artificial sequence
  Synthesized sequence
cgggcaggttgcgtgcc

SEQ ID NO: 6563 - DNA, 17 bp, Artificial sequence
  Synthesized sequence
ctggcggccaacctgcg

SEQ ID NO: 6564 - DNA, 17 bp, Artificial sequence
  Synthesized sequence
ccgctacagtggttgca

SEQ ID NO: 6565 - DNA, 17 bp, Artificial sequence
  Synthesized sequence
tgggcgtggtgatcgct

SEQ ID NO: 6566 - DNA, 17 bp, Artificial sequence
  Synthesized sequence
ctggcacgcggcatcga

SEQ ID NO: 6567 - DNA, 17 bp, Artificial sequence
  Synthesized sequence
cgggccggcagcctgct

SEQ ID NO: 6568 - DNA, 17 bp, Artificial sequence
  Synthesized sequence
caggcccgcgcgctgcc

SEQ ID NO: 6569 - DNA, 17 bp, Artificial sequence
  Synthesized sequence
gaggaattccgcttgcg

SEQ ID NO: 6570 - DNA, 17 bp, Artificial sequence
  Synthesized sequence
cgggcatccaccgtgcc

SEQ ID NO: 6571 - DNA, 17 bp, Artificial sequence
  Synthesized sequence
cgcgcatgaatcgtgca

SEQ ID NO: 6572 - DNA, 17 bp, Artificial sequence
  Synthesized sequence
gagggccggctatcgct

SEQ ID NO: 6573 - DNA, 17 bp, Artificial sequence
  Synthesized sequence
gagggccggctatcgct

SEQ ID NO: 6574 - DNA, 17 bp, Artificial sequence
  Synthesized sequence
atcgctcaaaacttgat

SEQ ID NO: 6575 - DNA, 17 bp, Artificial sequence
  Synthesized sequence
atcgctcaaaacttgat

SEQ ID NO: 6576 - DNA, 17 bp, Artificial sequence
  Synthesized sequence
ctggtcggcacggtgct

SEQ ID NO: 6577 - DNA, 17 bp, Artificial sequence
  Synthesized sequence
atgccccggccgatgcc

SEQ ID NO: 6578 - DNA, 17 bp, Artificial sequence
  Synthesized sequence
gtggcgcgggcggcgcc

SEQ ID NO: 6579 - DNA, 17 bp, Artificial sequence
  Synthesized sequence
atggcgcggcgctgtcg

SEQ ID NO: 6580 - DNA, 17 bp, Artificial sequence
  Synthesized sequence
tgggcgtgccgggtgca

SEQ ID NO: 6581 - DNA, 17 bp, Artificial sequence
  Synthesized sequence
atggcaagccattaggc

SEQ ID NO: 6582 - DNA, 17 bp, Artificial sequence
  Synthesized sequence
ggcgccctgcaattgct

SEQ ID NO: 6583 - DNA, 17 bp, Artificial sequence
  Synthesized sequence
tcggcaccgccttcgat

SEQ ID NO: 6584 - DNA, 17 bp, Artificial sequence
  Synthesized sequence
gtggctcgggccatggg

SEQ ID NO: 6585 - DNA, 17 bp, Artificial sequence
  Synthesized sequence
ttgtcatgggctttgtc

SEQ ID NO: 6586 - DNA, 17 bp, Artificial sequence
  Synthesized sequence
ctggcgaacacctcgcc

SEQ ID NO: 6587 - DNA, 17 bp, Artificial sequence
  Synthesized sequence
atggtcggcgaggtgct

SEQ ID NO: 6588 - DNA, 17 bp, Artificial sequence
  Synthesized sequence
ctggctcgaacgccgcc

SEQ ID NO: 6589 - DNA, 17 bp, Artificial sequence
  Synthesized sequence
gtggtgcgcggggtgcc

SEQ ID NO: 6590 - DNA, 17 bp, Artificial sequence
  Synthesized sequence
ctggtaccagcagcgct

SEQ ID NO: 6591 - DNA, 17 bp, Artificial sequence
  Synthesized sequence
ctggctctacgccggca

SEQ ID NO: 6592 - DNA, 17 bp, Artificial sequence
  Synthesized sequence
caggcccagaccctgcc

SEQ ID NO: 6593 - DNA, 17 bp, Artificial sequence
  Synthesized sequence
ctcgaacaggtgttcct

SEQ ID NO: 6594 - DNA, 17 bp, Artificial sequence
  Synthesized sequence
taggcgaggaattcgct

SEQ ID NO: 6595 - DNA, 17 bp, Artificial sequence
  Synthesized sequence
ccggcaggcggctggcc

SEQ ID NO: 6596 - DNA, 17 bp, Artificial sequence
  Synthesized sequence
ctggccctgatgttcgt

SEQ ID NO: 6597 - DNA, 17 bp, Artificial sequence
  Synthesized sequence
ctggccggctccgcgct

SEQ ID NO: 6598 - DNA, 17 bp, Artificial sequence
  Synthesized sequence
gtgggcttgttgctgct

SEQ ID NO: 6599 - DNA, 17 bp, Artificial sequence
  Synthesized sequence
ggggtgggcttgttgct

SEQ ID NO: 6600 - DNA, 17 bp, Artificial sequence
  Synthesized sequence
gaggcgcaggtgctgcg

SEQ ID NO: 6601 - DNA, 17 bp, Artificial sequence
  Synthesized sequence
acggcgcggaggtggcg

SEQ ID NO: 6602 - DNA, 17 bp, Artificial sequence
  Synthesized sequence
cttgcgcggtccctgcc

SEQ ID NO: 6603 - DNA, 17 bp, Artificial sequence
  Synthesized sequence
gtggcgcgcctgtgccg

SEQ ID NO: 6604 - DNA, 17 bp, Artificial sequence
  Synthesized sequence
ccggcagctagtgtgct

SEQ ID NO: 6605 - DNA, 17 bp, Artificial sequence
  Synthesized sequence
ccggcagctagtgtgct

SEQ ID NO: 6606 - DNA, 17 bp, Artificial sequence
  Synthesized sequence
aaggcctactacctgct

SEQ ID NO: 6607 - DNA, 17 bp, Artificial sequence
  Synthesized sequence
aaggcctactacctgct

SEQ ID NO: 6608 - DNA, 17 bp, Artificial sequence
  Synthesized sequence
gtggcaagagcgtcgag

SEQ ID NO: 6609 - DNA, 17 bp, Artificial sequence
  Synthesized sequence
gtggcaagagcgtcgag

SEQ ID NO: 6610 - DNA, 17 bp, Artificial sequence
  Synthesized sequence
atggcaagggtcgcgtt

SEQ ID NO: 6611 - DNA, 17 bp, Artificial sequence
  Synthesized sequence
gtgagctgcgttttgct

SEQ ID NO: 6612 - DNA, 17 bp, Artificial sequence
  Synthesized sequence
gtagcactgttcatggt

SEQ ID NO: 6613 - DNA, 17 bp, Artificial sequence
  Synthesized sequence
aagccacgggtctcgcg

SEQ ID NO: 6614 - DNA, 17 bp, Artificial sequence
  Synthesized sequence
ctggcgtgggggcggca

SEQ ID NO: 6615 - DNA, 17 bp, Artificial sequence
  Synthesized sequence
atggaagatggcctgcg

SEQ ID NO: 6616 - DNA, 17 bp, Artificial sequence
  Synthesized sequence
gatgcacgcccgttcca

SEQ ID NO: 6617 - DNA, 17 bp, Artificial sequence
  Synthesized sequence
ctgacctgaccgctgct

SEQ ID NO: 6618 - DNA, 17 bp, Artificial sequence
  Synthesized sequence
atggaagatggcctgcg

SEQ ID NO: 6619 - DNA, 17 bp, Artificial sequence
  Synthesized sequence
ctggcactggcttgccc

SEQ ID NO: 6620 - DNA, 17 bp, Artificial sequence
  Synthesized sequence
gtgccacgcgcggtgga

SEQ ID NO: 6621 - DNA, 17 bp, Artificial sequence
  Synthesized sequence
ctggctcgggtctatcc

SEQ ID NO: 6622 - DNA, 17 bp, Artificial sequence
  Synthesized sequence
atggccctgttcttcaa

SEQ ID NO: 6623 - DNA, 17 bp, Artificial sequence
  Synthesized sequence
atgtagcggcggttgcg

SEQ ID NO: 6624 - DNA, 17 bp, Artificial sequence
  Synthesized sequence
gcggaacctcccatgca

SEQ ID NO: 6625 - DNA, 17 bp, Artificial sequence
  Synthesized sequence
tcggcgcaggacctgcg

SEQ ID NO: 6626 - DNA, 17 bp, Artificial sequence
  Synthesized sequence
ttggcacatctgattat

SEQ ID NO: 6627 - DNA, 17 bp, Artificial sequence
  Synthesized sequence
ctgttcggcgtcttgct

SEQ ID NO: 6628 - DNA, 17 bp, Artificial sequence
  Synthesized sequence
acggcatcgacctggcg

SEQ ID NO: 6629 - DNA, 17 bp, Artificial sequence
  Synthesized sequence
ctggcctcgctcgggct

SEQ ID NO: 6630 - DNA, 17 bp, Artificial sequence
  Synthesized sequence
ccggagcagaccttgcg

SEQ ID NO: 6631 - DNA, 17 bp, Artificial sequence
  Synthesized sequence
gcggcgcggcgctttcc

SEQ ID NO: 6632 - DNA, 17 bp, Artificial sequence
  Synthesized sequence
gaggccggcgtctcgct

SEQ ID NO: 6633 - DNA, 17 bp, Artificial sequence
  Synthesized sequence
caggcactggccgcgca

SEQ ID NO: 6634 - DNA, 17 bp, Artificial sequence
  Synthesized sequence
ctggcaatgcgccagcg

SEQ ID NO: 6635 - DNA, 17 bp, Artificial sequence
  Synthesized sequence
ctggcgagcgagttggc

SEQ ID NO: 6636 - DNA, 17 bp, Artificial sequence
  Synthesized sequence
atcgccagcttcatgct

SEQ ID NO: 6637 - DNA, 17 bp, Artificial sequence
  Synthesized sequence
gaggtgcgcctgctgct

SEQ ID NO: 6638 - DNA, 17 bp, Artificial sequence
  Synthesized sequence
gcggctcgccagtggcg

SEQ ID NO: 6639 - DNA, 17 bp, Artificial sequence
  Synthesized sequence
gtggccgagcagtttcc

SEQ ID NO: 6640 - DNA, 17 bp, Artificial sequence
  Synthesized sequence
gcggcgcgggccttggg

SEQ ID NO: 6641 - DNA, 17 bp, Artificial sequence
  Synthesized sequence
ctgggacccggatttcc

SEQ ID NO: 6642 - DNA, 17 bp, Artificial sequence
  Synthesized sequence
ctggtcttcgtcctgct

SEQ ID NO: 6643 - DNA, 17 bp, Artificial sequence
  Synthesized sequence
gtggcgcggctccgggt

SEQ ID NO: 6644 - DNA, 17 bp, Artificial sequence
  Synthesized sequence
gtgctgcatgtattgct

SEQ ID NO: 6645 - DNA, 17 bp, Artificial sequence
  Synthesized sequence
cggacagggccgttgcc

SEQ ID NO: 6646 - DNA, 17 bp, Artificial sequence
  Synthesized sequence
gcggcctgggtcatgcg

SEQ ID NO: 6647 - DNA, 17 bp, Artificial sequence
  Synthesized sequence
atcgcccgaagcgtgcc

SEQ ID NO: 6648 - DNA, 17 bp, Artificial sequence
  Synthesized sequence
ctggaccggctgcagca

SEQ ID NO: 6649 - DNA, 17 bp, Artificial sequence
  Synthesized sequence
ctggcgcaggtgccgcc

SEQ ID NO: 6650 - DNA, 17 bp, Artificial sequence
  Synthesized sequence
ctggcgcagcaactggg

SEQ ID NO: 6651 - DNA, 17 bp, Artificial sequence
  Synthesized sequence
caggccaggccgctgca

SEQ ID NO: 6652 - DNA, 17 bp, Artificial sequence
  Synthesized sequence
ccggcagggatcgtcct

SEQ ID NO: 6653 - DNA, 17 bp, Artificial sequence
  Synthesized sequence
ctggtcaagccgctgct

SEQ ID NO: 6654 - DNA, 17 bp, Artificial sequence
  Synthesized sequence
gcggtaccgctggtgcg

SEQ ID NO: 6655 - DNA, 17 bp, Artificial sequence
  Synthesized sequence
atggcccacgccgtaca

SEQ ID NO: 6656 - DNA, 17 bp, Artificial sequence
  Synthesized sequence
ctggaccgcccatagcc

SEQ ID NO: 6657 - DNA, 17 bp, Artificial sequence
  Synthesized sequence
ttgtcatctcttttact

SEQ ID NO: 6658 - DNA, 17 bp, Artificial sequence
  Synthesized sequence
ctgacacgaaaatacct

SEQ ID NO: 6659 - DNA, 17 bp, Artificial sequence
  Synthesized sequence
gtggaccggatcctgga

SEQ ID NO: 6660 - DNA, 17 bp, Artificial sequence
  Synthesized sequence
gtcgcgccggccctgct

SEQ ID NO: 6661 - DNA, 17 bp, Artificial sequence
  Synthesized sequence
ctggcggggcgcctgga

SEQ ID NO: 6662 - DNA, 17 bp, Artificial sequence
  Synthesized sequence
ctggcacgccatccggg

SEQ ID NO: 6663 - DNA, 17 bp, Artificial sequence
  Synthesized sequence
atcgctcgcctgctgcc

SEQ ID NO: 6664 - DNA, 17 bp, Artificial sequence
  Synthesized sequence
gtggggcgatggtcgcg

SEQ ID NO: 6665 - DNA, 17 bp, Artificial sequence
  Synthesized sequence
gaggcacagggcattca

SEQ ID NO: 6666 - DNA, 17 bp, Artificial sequence
  Synthesized sequence
gaggcacagggcattca

SEQ ID NO: 6667 - DNA, 17 bp, Artificial sequence
  Synthesized sequence
ctggtactggctgggca

SEQ ID NO: 6668 - DNA, 17 bp, Artificial sequence
  Synthesized sequence
ttgatctgcgacttgct

SEQ ID NO: 6669 - DNA, 17 bp, Artificial sequence
  Synthesized sequence
atcgcccgccagctgcg

SEQ ID NO: 6670 - DNA, 17 bp, Artificial sequence
  Synthesized sequence
ctggtcagcgcgctgct

SEQ ID NO: 6671 - DNA, 17 bp, Artificial sequence
  Synthesized sequence
caggaaggccgcctgct

SEQ ID NO: 6672 - DNA, 17 bp, Artificial sequence
  Synthesized sequence
ctcgccgaggtgttgcc

SEQ ID NO: 6673 - DNA, 17 bp, Artificial sequence
  Synthesized sequence
atggcgccccctatact

SEQ ID NO: 6674 - DNA, 17 bp, Artificial sequence
  Synthesized sequence
atggtccaagactggcg

SEQ ID NO: 6675 - DNA, 17 bp, Artificial sequence
  Synthesized sequence
ctgccctggttttcgct

SEQ ID NO: 6676 - DNA, 17 bp, Artificial sequence
  Synthesized sequence
ccgggctgcctcttgcg

SEQ ID NO: 6677 - DNA, 17 bp, Artificial sequence
  Synthesized sequence
atggtgcgacgccggct

SEQ ID NO: 6678 - DNA, 17 bp, Artificial sequence
  Synthesized sequence
gcggcgcggcgatagcg

SEQ ID NO: 6679 - DNA, 17 bp, Artificial sequence
  Synthesized sequence
ctgggacatcgacggca

SEQ ID NO: 6680 - DNA, 17 bp, Artificial sequence
  Synthesized sequence
ctggccgggcatcggca

SEQ ID NO: 6681 - DNA, 17 bp, Artificial sequence
  Synthesized sequence
gtggcacgcctggcgtc

SEQ ID NO: 6682 - DNA, 17 bp, Artificial sequence
  Synthesized sequence
ctgcaactgaacgtgca

SEQ ID NO: 6683 - DNA, 17 bp, Artificial sequence
  Synthesized sequence
aaggcctggtggtcgct

SEQ ID NO: 6684 - DNA, 17 bp, Artificial sequence
  Synthesized sequence
ttggcatcgaactggag

SEQ ID NO: 6685 - DNA, 17 bp, Artificial sequence
  Synthesized sequence
gtggcaggagagtcccg

SEQ ID NO: 6686 - DNA, 17 bp, Artificial sequence
  Synthesized sequence
ctggcatttcggcttca

SEQ ID NO: 6687 - DNA, 17 bp, Artificial sequence
  Synthesized sequence
ctgacctggggtctgct

SEQ ID NO: 6688 - DNA, 17 bp, Artificial sequence
  Synthesized sequence
ctggtctcgccgctgct

SEQ ID NO: 6689 - DNA, 17 bp, Artificial sequence
  Synthesized sequence
ctggaacaactgcagcc

SEQ ID NO: 6690 - DNA, 17 bp, Artificial sequence
  Synthesized sequence
ctggcgctggccgtgga

SEQ ID NO: 6691 - DNA, 17 bp, Artificial sequence
  Synthesized sequence
ctgggaggactgctgta

SEQ ID NO: 6692 - DNA, 17 bp, Artificial sequence
  Synthesized sequence
agggccggaccgctgct

SEQ ID NO: 6693 - DNA, 17 bp, Artificial sequence
  Synthesized sequence
gtgcaacacacttcgct

SEQ ID NO: 6694 - DNA, 17 bp, Artificial sequence
  Synthesized sequence
tcggcccgaccatggcc

SEQ ID NO: 6695 - DNA, 17 bp, Artificial sequence
  Synthesized sequence
ctgggaggcttgacgct

SEQ ID NO: 6696 - DNA, 17 bp, Artificial sequence
  Synthesized sequence
ctgggaggcttgacgct

SEQ ID NO: 6697 - DNA, 17 bp, Artificial sequence
  Synthesized sequence
ctggcgctcgacatgtt

SEQ ID NO: 6698 - DNA, 17 bp, Artificial sequence
  Synthesized sequence
cgggccctgaacttcct

SEQ ID NO: 6699 - DNA, 17 bp, Artificial sequence
  Synthesized sequence
cgggccctgaacttcct

SEQ ID NO: 6700 - DNA, 17 bp, Artificial sequence
  Synthesized sequence
gtggcacttgcctcggc

SEQ ID NO: 6701 - DNA, 17 bp, Artificial sequence
  Synthesized sequence
ctgccacctagcatgcc

SEQ ID NO: 6702 - DNA, 17 bp, Artificial sequence
  Synthesized sequence
gtggcgaggctatcgaa

SEQ ID NO: 6703 - DNA, 17 bp, Artificial sequence
  Synthesized sequence
tcgccacagcgctcgca

SEQ ID NO: 6704 - DNA, 17 bp, Artificial sequence
  Synthesized sequence
gcggcaatccgcttgga

SEQ ID NO: 6705 - DNA, 17 bp, Artificial sequence
  Synthesized sequence
tcggcatgaccctggat

SEQ ID NO: 6706 - DNA, 17 bp, Artificial sequence
  Synthesized sequence
atgggcagtaccctgct

SEQ ID NO: 6707 - DNA, 17 bp, Artificial sequence
  Synthesized sequence
atggcctttcatgtgcc

SEQ ID NO: 6708 - DNA, 17 bp, Artificial sequence
  Synthesized sequence
ttgccgcctccgttgcc

SEQ ID NO: 6709 - DNA, 17 bp, Artificial sequence
  Synthesized sequence
cttgctcaaaagtcgct

SEQ ID NO: 6710 - DNA, 17 bp, Artificial sequence
  Synthesized sequence
gtggtccaggcgctgcc

SEQ ID NO: 6711 - DNA, 17 bp, Artificial sequence
  Synthesized sequence
ctggaacttcaaccgct

SEQ ID NO: 6712 - DNA, 17 bp, Artificial sequence
  Synthesized sequence
ttgccgcagaccttgga

SEQ ID NO: 6713 - DNA, 17 bp, Artificial sequence
  Synthesized sequence
ttggagccggcctggca

SEQ ID NO: 6714 - DNA, 17 bp, Artificial sequence
  Synthesized sequence
tcggctcgatcggtgcc

SEQ ID NO: 6715 - DNA, 17 bp, Artificial sequence
  Synthesized sequence
atggaaggttccttggc

SEQ ID NO: 6716 - DNA, 17 bp, Artificial sequence
  Synthesized sequence
ctggcaaccggcgagca

SEQ ID NO: 6717 - DNA, 17 bp, Artificial sequence
  Synthesized sequence
ctggtcagcgaggtgct

SEQ ID NO: 6718 - DNA, 17 bp, Artificial sequence
  Synthesized sequence
ctgaaacgcctgtagcg

SEQ ID NO: 6719 - DNA, 17 bp, Artificial sequence
  Synthesized sequence
agggctcgtctgtcgcg

SEQ ID NO: 6720 - DNA, 17 bp, Artificial sequence
  Synthesized sequence
ggcgcacgcgcggtgca

SEQ ID NO: 6721 - DNA, 17 bp, Artificial sequence
  Synthesized sequence
taagcccggatgttgcc

SEQ ID NO: 6722 - DNA, 17 bp, Artificial sequence
  Synthesized sequence
ctcgggcgcctgttgcc

SEQ ID NO: 6723 - DNA, 17 bp, Artificial sequence
  Synthesized sequence
ctggagcgcgtattgtc

SEQ ID NO: 6724 - DNA, 17 bp, Artificial sequence
  Synthesized sequence
ctggcccgcggcctgac

SEQ ID NO: 6725 - DNA, 17 bp, Artificial sequence
  Synthesized sequence
ctggcagccgccgagca

SEQ ID NO: 6726 - DNA, 17 bp, Artificial sequence
  Synthesized sequence
ctggatcaactatcgcc

SEQ ID NO: 6727 - DNA, 17 bp, Artificial sequence
  Synthesized sequence
ttggtcgcccgcttgcg

SEQ ID NO: 6728 - DNA, 17 bp, Artificial sequence
  Synthesized sequence
ttcgactgaggcttgct

SEQ ID NO: 6729 - DNA, 17 bp, Artificial sequence
  Synthesized sequence
atggcctgtaccctgtt

SEQ ID NO: 6730 - DNA, 17 bp, Artificial sequence
  Synthesized sequence
ctggtgaacgtcctgct

SEQ ID NO: 6731 - DNA, 17 bp, Artificial sequence
  Synthesized sequence
acggcacggccctggac

SEQ ID NO: 6732 - DNA, 17 bp, Artificial sequence
  Synthesized sequence
agcgcacactccctgct

SEQ ID NO: 6733 - DNA, 17 bp, Artificial sequence
  Synthesized sequence
atggcatccaggtccca

SEQ ID NO: 6734 - DNA, 17 bp, Artificial sequence
  Synthesized sequence
gtggtcgaactggtgca

SEQ ID NO: 6735 - DNA, 17 bp, Artificial sequence
  Synthesized sequence
cgggcacggtatgggcg

SEQ ID NO: 6736 - DNA, 17 bp, Artificial sequence
  Synthesized sequence
ctggaaatgccgatgcc

SEQ ID NO: 6737 - DNA, 17 bp, Artificial sequence
  Synthesized sequence
gcgccaggccgcttgcc

SEQ ID NO: 6738 - DNA, 17 bp, Artificial sequence
  Synthesized sequence
ttggcaccgaatccact

SEQ ID NO: 6739 - DNA, 17 bp, Artificial sequence
  Synthesized sequence
atgccactgagattggc

SEQ ID NO: 6740 - DNA, 17 bp, Artificial sequence
  Synthesized sequence
atgccacgcgaggtgga

SEQ ID NO: 6741 - DNA, 17 bp, Artificial sequence
  Synthesized sequence
tcggcgcggcgtttgtc

SEQ ID NO: 6742 - DNA, 17 bp, Artificial sequence
  Synthesized sequence
atgggcggctcgctgct

SEQ ID NO: 6743 - DNA, 17 bp, Artificial sequence
  Synthesized sequence
ccggccccgcggtcgca

SEQ ID NO: 6744 - DNA, 17 bp, Artificial sequence
  Synthesized sequence
cgggcacaagctcggca

SEQ ID NO: 6745 - DNA, 17 bp, Artificial sequence
  Synthesized sequence
atcggactgctgtcgct

SEQ ID NO: 6746 - DNA, 17 bp, Artificial sequence
  Synthesized sequence
gcggtccgcctgatgca

SEQ ID NO: 6747 - DNA, 17 bp, Artificial sequence
  Synthesized sequence
cttgcaccagctttgac

SEQ ID NO: 6748 - DNA, 17 bp, Artificial sequence
  Synthesized sequence
ctcgcgcagtcgtggct

SEQ ID NO: 6749 - DNA, 17 bp, Artificial sequence
  Synthesized sequence
cttgccgatgctttgca

SEQ ID NO: 6750 - DNA, 17 bp, Artificial sequence
  Synthesized sequence
ctgctgctggtgttgca

SEQ ID NO: 6751 - DNA, 17 bp, Artificial sequence
  Synthesized sequence
gcagcacaagatctgct

SEQ ID NO: 6752 - DNA, 17 bp, Artificial sequence
  Synthesized sequence
ttgccgaagcctttgcc

SEQ ID NO: 6753 - DNA, 17 bp, Artificial sequence
  Synthesized sequence
ctcggccatcagttgct

SEQ ID NO: 6754 - DNA, 17 bp, Artificial sequence
  Synthesized sequence
gtcgcaaagcctctgcc

SEQ ID NO: 6755 - DNA, 17 bp, Artificial sequence
  Synthesized sequence
cttgcatgggggttggc

SEQ ID NO: 6756 - DNA, 17 bp, Artificial sequence
  Synthesized sequence
ctggcccaggcatacct

SEQ ID NO: 6757 - DNA, 17 bp, Artificial sequence
  Synthesized sequence
ctggccggagtacggct

SEQ ID NO: 6758 - DNA, 17 bp, Artificial sequence
  Synthesized sequence
ctcgcccgcaccctgcg

SEQ ID NO: 6759 - DNA, 17 bp, Artificial sequence
  Synthesized sequence
aaggcgctctccgtgca

SEQ ID NO: 6760 - DNA, 17 bp, Artificial sequence
  Synthesized sequence
ttcgcggatgcgttgct

SEQ ID NO: 6761 - DNA, 17 bp, Artificial sequence
  Synthesized sequence
gcggcccggcgatggcc

SEQ ID NO: 6762 - DNA, 17 bp, Artificial sequence
  Synthesized sequence
gtggccgggcggcggca

SEQ ID NO: 6763 - DNA, 17 bp, Artificial sequence
  Synthesized sequence
caggggctcgccttgct

SEQ ID NO: 6764 - DNA, 17 bp, Artificial sequence
  Synthesized sequence
acggtacggctcgttct

SEQ ID NO: 6765 - DNA, 17 bp, Artificial sequence
  Synthesized sequence
ctggctcgatctgcgcc

SEQ ID NO: 6766 - DNA, 17 bp, Artificial sequence
  Synthesized sequence
ctggcgccagtacttca

SEQ ID NO: 6767 - DNA, 17 bp, Artificial sequence
  Synthesized sequence
ccggcccgtccctcgcc

SEQ ID NO: 6768 - DNA, 17 bp, Artificial sequence
  Synthesized sequence
ctggtgcggcggtttcc

SEQ ID NO: 6769 - DNA, 17 bp, Artificial sequence
  Synthesized sequence
ctggtgggcacgctgct

SEQ ID NO: 6770 - DNA, 17 bp, Artificial sequence
  Synthesized sequence
ccggcccagcagatgcc

SEQ ID NO: 6771 - DNA, 17 bp, Artificial sequence
  Synthesized sequence
ctggcgcgacggctggc

SEQ ID NO: 6772 - DNA, 17 bp, Artificial sequence
  Synthesized sequence
ttggcgaaaaccttgtc

SEQ ID NO: 6773 - DNA, 17 bp, Artificial sequence
  Synthesized sequence
acggcgggccaagtgct

SEQ ID NO: 6774 - DNA, 17 bp, Artificial sequence
  Synthesized sequence
aagccacggacgttgta

SEQ ID NO: 6775 - DNA, 17 bp, Artificial sequence
  Synthesized sequence
ccggctcggtgctggcg

SEQ ID NO: 6776 - DNA, 17 bp, Artificial sequence
  Synthesized sequence
gaggctcgcagcctgcc

SEQ ID NO: 6777 - DNA, 17 bp, Artificial sequence
  Synthesized sequence
ctcgcacagcgaacgca

SEQ ID NO: 6778 - DNA, 17 bp, Artificial sequence
  Synthesized sequence
ccggcctaccgcctgct

SEQ ID NO: 6779 - DNA, 17 bp, Artificial sequence
  Synthesized sequence
gtggccaacgaagtgcc

SEQ ID NO: 6780 - DNA, 17 bp, Artificial sequence
  Synthesized sequence
gtggcgcgctgcctggc

SEQ ID NO: 6781 - DNA, 17 bp, Artificial sequence
  Synthesized sequence
gtggcgcgctgcctggc

SEQ ID NO: 6782 - DNA, 17 bp, Artificial sequence
  Synthesized sequence
ctggcacgcggtctcaa

SEQ ID NO: 6783 - DNA, 17 bp, Artificial sequence
  Synthesized sequence
ttggcgctgctttccca

SEQ ID NO: 6784 - DNA, 17 bp, Artificial sequence
  Synthesized sequence
ctggcacggcctgcccg

SEQ ID NO: 6785 - DNA, 17 bp, Artificial sequence
  Synthesized sequence
ctggagctgccgttcca

SEQ ID NO: 6786 - DNA, 17 bp, Artificial sequence
  Synthesized sequence
ctggcgcagccgcggcg

SEQ ID NO: 6787 - DNA, 17 bp, Artificial sequence
  Synthesized sequence
ctggccggggtgctgat

SEQ ID NO: 6788 - DNA, 17 bp, Artificial sequence
  Synthesized sequence
tcggcgcggcgatggcc

SEQ ID NO: 6789 - DNA, 17 bp, Artificial sequence
  Synthesized sequence
aaggcgtggcggtggct

SEQ ID NO: 6790 - DNA, 17 bp, Artificial sequence
  Synthesized sequence
ctggccagttggttgag

SEQ ID NO: 6791 - DNA, 17 bp, Artificial sequence
  Synthesized sequence
gtggcccatgacgttct

SEQ ID NO: 6792 - DNA, 17 bp, Artificial sequence
  Synthesized sequence
gcggcgccgtgctagct

SEQ ID NO: 6793 - DNA, 17 bp, Artificial sequence
  Synthesized sequence
aaggccggcaagctgct

SEQ ID NO: 6794 - DNA, 17 bp, Artificial sequence
  Synthesized sequence
agggcaagaggatggcg

SEQ ID NO: 6795 - DNA, 17 bp, Artificial sequence
  Synthesized sequence
ccggcgctggaagtgca

SEQ ID NO: 6796 - DNA, 17 bp, Artificial sequence
  Synthesized sequence
ccggcaagatcgttccg

SEQ ID NO: 6797 - DNA, 17 bp, Artificial sequence
  Synthesized sequence
ctggaagacaacttccg

SEQ ID NO: 6798 - DNA, 17 bp, Artificial sequence
  Synthesized sequence
ctggaagacaacttccg

SEQ ID NO: 6799 - DNA, 17 bp, Artificial sequence
  Synthesized sequence
ctggaaaagctccagca

SEQ ID NO: 6800 - DNA, 17 bp, Artificial sequence
  Synthesized sequence
gtcgcgccggagctgct

SEQ ID NO: 6801 - DNA, 17 bp, Artificial sequence
  Synthesized sequence
ctggaacagggtttcat

SEQ ID NO: 6802 - DNA, 17 bp, Artificial sequence
  Synthesized sequence
ctggacaagctcttcct

SEQ ID NO: 6803 - DNA, 17 bp, Artificial sequence
  Synthesized sequence
ccggcacctacatcgcc

SEQ ID NO: 6804 - DNA, 17 bp, Artificial sequence
  Synthesized sequence
cgggcatcaccggtgcc

SEQ ID NO: 6805 - DNA, 17 bp, Artificial sequence
  Synthesized sequence
caggtgcgcttcgtgct

SEQ ID NO: 6806 - DNA, 17 bp, Artificial sequence
  Synthesized sequence
gtggaagtagccttcca

SEQ ID NO: 6807 - DNA, 17 bp, Artificial sequence
  Synthesized sequence
ttcgcacgtccggtcct

SEQ ID NO: 6808 - DNA, 17 bp, Artificial sequence
  Synthesized sequence
ttggctcgcgcgtccca

SEQ ID NO: 6809 - DNA, 17 bp, Artificial sequence
  Synthesized sequence
ctgcaaaggatgctgct

SEQ ID NO: 6810 - DNA, 17 bp, Artificial sequence
  Synthesized sequence
ctggcgctgcgagggca

SEQ ID NO: 6811 - DNA, 17 bp, Artificial sequence
  Synthesized sequence
ctggcgccctatccgca

SEQ ID NO: 6812 - DNA, 17 bp, Artificial sequence
  Synthesized sequence
ctggaagcgccgctgcc

SEQ ID NO: 6813 - DNA, 17 bp, Artificial sequence
  Synthesized sequence
ctcgccctgtgcatgct

SEQ ID NO: 6814 - DNA, 17 bp, Artificial sequence
  Synthesized sequence
gcggccaagcgcctgct

SEQ ID NO: 6815 - DNA, 17 bp, Artificial sequence
  Synthesized sequence
ctcgatccgcaattgct

SEQ ID NO: 6816 - DNA, 17 bp, Artificial sequence
  Synthesized sequence
atggccgagctgctgat

SEQ ID NO: 6817 - DNA, 17 bp, Artificial sequence
  Synthesized sequence
gtagcacaggacctcca

SEQ ID NO: 6818 - DNA, 17 bp, Artificial sequence
  Synthesized sequence
ctgccatctatcttgaa

SEQ ID NO: 6819 - DNA, 17 bp, Artificial sequence
  Synthesized sequence
gcggcactggatcggct

SEQ ID NO: 6820 - DNA, 17 bp, Artificial sequence
  Synthesized sequence
ctggagccgatgctgcg

SEQ ID NO: 6821 - DNA, 17 bp, Artificial sequence
  Synthesized sequence
gcggccggacagatgca

SEQ ID NO: 6822 - DNA, 17 bp, Artificial sequence
  Synthesized sequence
atggtcggcgacatgca

SEQ ID NO: 6823 - DNA, 17 bp, Artificial sequence
  Synthesized sequence
ctggcgccgaccgtgga

SEQ ID NO: 6824 - DNA, 17 bp, Artificial sequence
  Synthesized sequence
tggccaaggtgcttgcc

SEQ ID NO: 6825 - DNA, 17 bp, Artificial sequence
  Synthesized sequence
ctggcggcggggttgga

SEQ ID NO: 6826 - DNA, 17 bp, Artificial sequence
  Synthesized sequence
ctggcaactatgtcgat

SEQ ID NO: 6827 - DNA, 17 bp, Artificial sequence
  Synthesized sequence
gcggcccggtgatcgcc

SEQ ID NO: 6828 - DNA, 17 bp, Artificial sequence
  Synthesized sequence
ccggcgcaaccgctgcg

SEQ ID NO: 6829 - DNA, 17 bp, Artificial sequence
  Synthesized sequence
atggttctgatcctgcc

SEQ ID NO: 6830 - DNA, 17 bp, Artificial sequence
  Synthesized sequence
agggctcgccgctggcg

SEQ ID NO: 6831 - DNA, 17 bp, Artificial sequence
  Synthesized sequence
gtgcggcggctcatgct

SEQ ID NO: 6832 - DNA, 17 bp, Artificial sequence
  Synthesized sequence
gcggcaagctgttcgcc

SEQ ID NO: 6833 - DNA, 17 bp, Artificial sequence
  Synthesized sequence
ctgcgtctggttttgct

SEQ ID NO: 6834 - DNA, 17 bp, Artificial sequence
  Synthesized sequence
gaggtacccgggctgct

SEQ ID NO: 6835 - DNA, 17 bp, Artificial sequence
  Synthesized sequence
gtcacagaaaaattgct

SEQ ID NO: 6836 - DNA, 17 bp, Artificial sequence
  Synthesized sequence
ctggcgcacctgttcga

SEQ ID NO: 6837 - DNA, 17 bp, Artificial sequence
  Synthesized sequence
ctggttcccgagctgca

SEQ ID NO: 6838 - DNA, 17 bp, Artificial sequence
  Synthesized sequence
ctgccattcgcactgca

SEQ ID NO: 6839 - DNA, 17 bp, Artificial sequence
  Synthesized sequence
atggatcgactcctgat

SEQ ID NO: 6840 - DNA, 17 bp, Artificial sequence
  Synthesized sequence
caggcgcgagaactgcc

SEQ ID NO: 6841 - DNA, 17 bp, Artificial sequence
  Synthesized sequence
ctggtgggcgcggtgct

SEQ ID NO: 6842 - DNA, 17 bp, Artificial sequence
  Synthesized sequence
ctggaacgccgacggcc

SEQ ID NO: 6843 - DNA, 17 bp, Artificial sequence
  Synthesized sequence
ctggcgtggggcgtgga

SEQ ID NO: 6844 - DNA, 17 bp, Artificial sequence
  Synthesized sequence
cgggagcgcatcatgct

SEQ ID NO: 6845 - DNA, 17 bp, Artificial sequence
  Synthesized sequence
ctggcactgctgcgcca

SEQ ID NO: 6846 - DNA, 17 bp, Artificial sequence
  Synthesized sequence
ctcgcgccagtcctgca

SEQ ID NO: 6847 - DNA, 17 bp, Artificial sequence
  Synthesized sequence
caggcgcagcaggtgcg

SEQ ID NO: 6848 - DNA, 17 bp, Artificial sequence
  Synthesized sequence
caggccagggctatgct

SEQ ID NO: 6849 - DNA, 17 bp, Artificial sequence
  Synthesized sequence
gtggactgaatgatgcg

SEQ ID NO: 6850 - DNA, 17 bp, Artificial sequence
  Synthesized sequence
atggcctgtaccctgtt

SEQ ID NO: 6851 - DNA, 17 bp, Artificial sequence
  Synthesized sequence
atggccctgtcgatggt

SEQ ID NO: 6852 - DNA, 17 bp, Artificial sequence
  Synthesized sequence
ctggcacgcctgggtcg

SEQ ID NO: 6853 - DNA, 17 bp, Artificial sequence
  Synthesized sequence
cgggcaccggcccggca

SEQ ID NO: 6854 - DNA, 17 bp, Artificial sequence
  Synthesized sequence
ttggcgctgggcgggca

SEQ ID NO: 6855 - DNA, 17 bp, Artificial sequence
  Synthesized sequence
ttcgaccgccagttgcc

SEQ ID NO: 6856 - DNA, 17 bp, Artificial sequence
  Synthesized sequence
ctggcgctgagcctgga

SEQ ID NO: 6857 - DNA, 17 bp, Artificial sequence
  Synthesized sequence
ctggagcgttcgctgcg

SEQ ID NO: 6858 - DNA, 17 bp, Artificial sequence
  Synthesized sequence
gtggaacatgcagggct

SEQ ID NO: 6859 - DNA, 17 bp, Artificial sequence
  Synthesized sequence
atgacgtggaacatgca

SEQ ID NO: 6860 - DNA, 17 bp, Artificial sequence
  Synthesized sequence
gtggccggtgaatggcc

SEQ ID NO: 6861 - DNA, 17 bp, Artificial sequence
  Synthesized sequence
caggcccttagcctgct

SEQ ID NO: 6862 - DNA, 17 bp, Artificial sequence
  Synthesized sequence
ctggctcgtcgcttcga

SEQ ID NO: 6863 - DNA, 17 bp, Artificial sequence
  Synthesized sequence
aaggctcgcgtttcgcc

SEQ ID NO: 6864 - DNA, 17 bp, Artificial sequence
  Synthesized sequence
ctggccgaaggctcgcg

SEQ ID NO: 6865 - DNA, 17 bp, Artificial sequence
  Synthesized sequence
cgtgcacagctattaca

SEQ ID NO: 6866 - DNA, 17 bp, Artificial sequence
  Synthesized sequence
ttggcgaaggcctggcc

SEQ ID NO: 6867 - DNA, 17 bp, Artificial sequence
  Synthesized sequence
ctggcccagctctgccg

SEQ ID NO: 6868 - DNA, 17 bp, Artificial sequence
  Synthesized sequence
gtgggcggcggcctgct

SEQ ID NO: 6869 - DNA, 17 bp, Artificial sequence
  Synthesized sequence
ctgacgcggatcttccg

SEQ ID NO: 6870 - DNA, 17 bp, Artificial sequence
  Synthesized sequence
ctgtcgcagcgcttcct

SEQ ID NO: 6871 - DNA, 17 bp, Artificial sequence
  Synthesized sequence
ctggcgtcctggctgcg

SEQ ID NO: 6872 - DNA, 17 bp, Artificial sequence
  Synthesized sequence
ctggccggcaagccgct

SEQ ID NO: 6873 - DNA, 17 bp, Artificial sequence
  Synthesized sequence
cggggctgggagttgca

SEQ ID NO: 6874 - DNA, 17 bp, Artificial sequence
  Synthesized sequence
tcggcaagcagatcgcc

SEQ ID NO: 6875 - DNA, 17 bp, Artificial sequence
  Synthesized sequence
agggcatcgaactggcg

SEQ ID NO: 6876 - DNA, 17 bp, Artificial sequence
  Synthesized sequence
ctggagcaggccctgcc

SEQ ID NO: 6877 - DNA, 17 bp, Artificial sequence
  Synthesized sequence
ctggcgccgcgatcggt

SEQ ID NO: 6878 - DNA, 17 bp, Artificial sequence
  Synthesized sequence
cagccgcacgtgttgca

SEQ ID NO: 6879 - DNA, 17 bp, Artificial sequence
  Synthesized sequence
ttggcccatcctgttca

SEQ ID NO: 6880 - DNA, 17 bp, Artificial sequence
  Synthesized sequence
tggaaactgcccttgct

SEQ ID NO: 6881 - DNA, 17 bp, Artificial sequence
  Synthesized sequence
ctggcgccggtgtcgat

SEQ ID NO: 6882 - DNA, 17 bp, Artificial sequence
  Synthesized sequence
ctgcgaatgctcttgcg

SEQ ID NO: 6883 - DNA, 17 bp, Artificial sequence
  Synthesized sequence
tgggcctggccgttgga

SEQ ID NO: 6884 - DNA, 17 bp, Artificial sequence
  Synthesized sequence
ccggcgcggtgctggcg

SEQ ID NO: 6885 - DNA, 17 bp, Artificial sequence
  Synthesized sequence
ctggtcggcgcggtgct

SEQ ID NO: 6886 - DNA, 17 bp, Artificial sequence
  Synthesized sequence
ctggcgcggtgagcgcc

SEQ ID NO: 6887 - DNA, 17 bp, Artificial sequence
  Synthesized sequence
ctgctccggggcttgcg

SEQ ID NO: 6888 - DNA, 17 bp, Artificial sequence
  Synthesized sequence
ctggcgcgaagagcgcg

SEQ ID NO: 6889 - DNA, 17 bp, Artificial sequence
  Synthesized sequence
gtggatcgactggcgct

SEQ ID NO: 6890 - DNA, 17 bp, Artificial sequence
  Synthesized sequence
gtcttacggctgttgcg

SEQ ID NO: 6891 - DNA, 17 bp, Artificial sequence
  Synthesized sequence
gtggtatttcgcgtgcc

SEQ ID NO: 6892 - DNA, 17 bp, Artificial sequence
  Synthesized sequence
ctgggccaggaagtgcg

SEQ ID NO: 6893 - DNA, 17 bp, Artificial sequence
  Synthesized sequence
agggcacgccaagcgcg

SEQ ID NO: 6894 - DNA, 17 bp, Artificial sequence
  Synthesized sequence
gtcggacgcgaattgaa

SEQ ID NO: 6895 - DNA, 17 bp, Artificial sequence
  Synthesized sequence
gtggcttcggcgctgcg

SEQ ID NO: 6896 - DNA, 17 bp, Artificial sequence
  Synthesized sequence
gtgctacgcgtactgcg

SEQ ID NO: 6897 - DNA, 17 bp, Artificial sequence
  Synthesized sequence
ctggggcgaccgttgac

SEQ ID NO: 6898 - DNA, 17 bp, Artificial sequence
  Synthesized sequence
gtcggccaggcgttgca

SEQ ID NO: 6899 - DNA, 17 bp, Artificial sequence
  Synthesized sequence
ttggcccgagataggcc

SEQ ID NO: 6900 - DNA, 17 bp, Artificial sequence
  Synthesized sequence
aaggcacgcgacaggcg

SEQ ID NO: 6901 - DNA, 17 bp, Artificial sequence
  Synthesized sequence
gtgcgacgatgatagca

SEQ ID NO: 6902 - DNA, 17 bp, Artificial sequence
  Synthesized sequence
ttggcgtcgagctggcg

SEQ ID NO: 6903 - DNA, 17 bp, Artificial sequence
  Synthesized sequence
ataggggggatgttgct

SEQ ID NO: 6904 - DNA, 17 bp, Artificial sequence
  Synthesized sequence
ccggcatcccctctgcc

SEQ ID NO: 6905 - DNA, 17 bp, Artificial sequence
  Synthesized sequence
ccggcatcccctctgcc

SEQ ID NO: 6906 - DNA, 17 bp, Artificial sequence
  Synthesized sequence
gccgcaccggtactgct

SEQ ID NO: 6907 - DNA, 17 bp, Artificial sequence
  Synthesized sequence
atcggtcacagcttgca

SEQ ID NO: 6908 - DNA, 17 bp, Artificial sequence
  Synthesized sequence
ctggtgaacaacctgct

SEQ ID NO: 6909 - DNA, 17 bp, Artificial sequence
  Synthesized sequence
ctgccacggcaccggcc

SEQ ID NO: 6910 - DNA, 17 bp, Artificial sequence
  Synthesized sequence
ctcggcctgcgcttgca

SEQ ID NO: 6911 - DNA, 17 bp, Artificial sequence
  Synthesized sequence
ctcggcctgcgcttgca

SEQ ID NO: 6912 - DNA, 17 bp, Artificial sequence
  Synthesized sequence
ctggccagtgtttttcc

SEQ ID NO: 6913 - DNA, 17 bp, Artificial sequence
  Synthesized sequence
ctggctcggaaaatccg

SEQ ID NO: 6914 - DNA, 17 bp, Artificial sequence
  Synthesized sequence
ctgtcaaatatattgaa

SEQ ID NO: 6915 - DNA, 17 bp, Artificial sequence
  Synthesized sequence
ctggtcggcggcgtgca

SEQ ID NO: 6916 - DNA, 17 bp, Artificial sequence
  Synthesized sequence
tcgccaacggccttgca

SEQ ID NO: 6917 - DNA, 17 bp, Artificial sequence
  Synthesized sequence
agggcacgcagcccgcc

SEQ ID NO: 6918 - DNA, 17 bp, Artificial sequence
  Synthesized sequence
atgccctgcgacctgct

SEQ ID NO: 6919 - DNA, 17 bp, Artificial sequence
  Synthesized sequence
aacgcgcaccagttgca

SEQ ID NO: 6920 - DNA, 17 bp, Artificial sequence
  Synthesized sequence
gcgtgacagagcttgca

SEQ ID NO: 6921 - DNA, 17 bp, Artificial sequence
  Synthesized sequence
tcggcgctgacggtgca

SEQ ID NO: 6922 - DNA, 17 bp, Artificial sequence
  Synthesized sequence
ctcgctcggccactgcg

SEQ ID NO: 6923 - DNA, 17 bp, Artificial sequence
  Synthesized sequence
atcgggcgtgcattgca

SEQ ID NO: 6924 - DNA, 17 bp, Artificial sequence
  Synthesized sequence
ctggcgcgccagcttcc

SEQ ID NO: 6925 - DNA, 17 bp, Artificial sequence
  Synthesized sequence
ctggcagaccctgcgcg

SEQ ID NO: 6926 - DNA, 17 bp, Artificial sequence
  Synthesized sequence
ctgtcatattcctttca

SEQ ID NO: 6927 - DNA, 17 bp, Artificial sequence
  Synthesized sequence
ctggcgtctcccatgcc

SEQ ID NO: 6928 - DNA, 17 bp, Artificial sequence
  Synthesized sequence
ctggcgctgagcgagca

SEQ ID NO: 6929 - DNA, 17 bp, Artificial sequence
  Synthesized sequence
ctgggccggcttcggca

SEQ ID NO: 6930 - DNA, 17 bp, Artificial sequence
  Synthesized sequence
ctgggacatggggcgct

SEQ ID NO: 6931 - DNA, 17 bp, Artificial sequence
  Synthesized sequence
atcccacggatcctgcc

SEQ ID NO: 6932 - DNA, 17 bp, Artificial sequence
  Synthesized sequence
ccggcacggccgctccc

SEQ ID NO: 6933 - DNA, 17 bp, Artificial sequence
  Synthesized sequence
cagctaccactattgca

SEQ ID NO: 6934 - DNA, 17 bp, Artificial sequence
  Synthesized sequence
cagctaccactattgca

SEQ ID NO: 6935 - DNA, 17 bp, Artificial sequence
  Synthesized sequence
gtggcgtcgttgtagcc

SEQ ID NO: 6936 - DNA, 17 bp, Artificial sequence
  Synthesized sequence
ctggcaaagggaccgcg

SEQ ID NO: 6937 - DNA, 17 bp, Artificial sequence
  Synthesized sequence
ctggcgcggtcgatggc

SEQ ID NO: 6938 - DNA, 17 bp, Artificial sequence
  Synthesized sequence
ctggcgcgggcggtggg

SEQ ID NO: 6939 - DNA, 17 bp, Artificial sequence
  Synthesized sequence
caggcgcaatacatgcg

SEQ ID NO: 6940 - DNA, 17 bp, Artificial sequence
  Synthesized sequence
caggcgcaatacatgcg

SEQ ID NO: 6941 - DNA, 17 bp, Artificial sequence
  Synthesized sequence
atcgccccgcgcgtgca

SEQ ID NO: 6942 - DNA, 17 bp, Artificial sequence
  Synthesized sequence
gtggcagggtcatggtc

SEQ ID NO: 6943 - DNA, 17 bp, Artificial sequence
  Synthesized sequence
ctaccaccgctcctgct

SEQ ID NO: 6944 - DNA, 17 bp, Artificial sequence
  Synthesized sequence
caggcgcgcacgatgcg

SEQ ID NO: 6945 - DNA, 17 bp, Artificial sequence
  Synthesized sequence
ctggtacggtcgatccg

SEQ ID NO: 6946 - DNA, 17 bp, Artificial sequence
  Synthesized sequence
taggagcggctctcgca

SEQ ID NO: 6947 - DNA, 17 bp, Artificial sequence
  Synthesized sequence
ctggaggaaggtttgcg

SEQ ID NO: 6948 - DNA, 17 bp, Artificial sequence
  Synthesized sequence
atcggccggccgttgcc

SEQ ID NO: 6949 - DNA, 17 bp, Artificial sequence
  Synthesized sequence
tttgcccggcttttccc

SEQ ID NO: 6950 - DNA, 17 bp, Artificial sequence
  Synthesized sequence
ttgtcgctgcagatgca

SEQ ID NO: 6951 - DNA, 17 bp, Artificial sequence
  Synthesized sequence
atgtggctgatgttgca

SEQ ID NO: 6952 - DNA, 17 bp, Artificial sequence
  Synthesized sequence
ccggcatgacctctgga

SEQ ID NO: 6953 - DNA, 17 bp, Artificial sequence
  Synthesized sequence
cgggcggaacagttgcc

SEQ ID NO: 6954 - DNA, 17 bp, Artificial sequence
  Synthesized sequence
cgggcggaacagttgcc

SEQ ID NO: 6955 - DNA, 17 bp, Artificial sequence
  Synthesized sequence
gtggcgcacagttggtt

SEQ ID NO: 6956 - DNA, 17 bp, Artificial sequence
  Synthesized sequence
ctgaaatgggccgtgct

SEQ ID NO: 6957 - DNA, 17 bp, Artificial sequence
  Synthesized sequence
gtggtcggcgcgctgct

SEQ ID NO: 6958 - DNA, 17 bp, Artificial sequence
  Synthesized sequence
ccggcgctgtcctggct

SEQ ID NO: 6959 - DNA, 17 bp, Artificial sequence
  Synthesized sequence
attgcccgaaaggtgcg

SEQ ID NO: 6960 - DNA, 17 bp, Artificial sequence
  Synthesized sequence
cttgcatgggctttccg

SEQ ID NO: 6961 - DNA, 17 bp, Artificial sequence
  Synthesized sequence
tcggcgctggcgatgct

SEQ ID NO: 6962 - DNA, 17 bp, Artificial sequence
  Synthesized sequence
ttcgccctgggcctgct

SEQ ID NO: 6963 - DNA, 17 bp, Artificial sequence
  Synthesized sequence
attgccggcgaattgcg

SEQ ID NO: 6964 - DNA, 17 bp, Artificial sequence
  Synthesized sequence
atgccgcggattttgtg

SEQ ID NO: 6965 - DNA, 17 bp, Artificial sequence
  Synthesized sequence
atgccgcggattttgtg

SEQ ID NO: 6966 - DNA, 17 bp, Artificial sequence
  Synthesized sequence
gaggcctacgggttgcg

SEQ ID NO: 6967 - DNA, 17 bp, Artificial sequence
  Synthesized sequence
ctgccagaccagttcca

SEQ ID NO: 6968 - DNA, 17 bp, Artificial sequence
  Synthesized sequence
ctggccctgtcctggtt

SEQ ID NO: 6969 - DNA, 17 bp, Artificial sequence
  Synthesized sequence
gtgcccctgccgatgct

SEQ ID NO: 6970 - DNA, 17 bp, Artificial sequence
  Synthesized sequence
atggcgcggccctgggc

SEQ ID NO: 6971 - DNA, 17 bp, Artificial sequence
  Synthesized sequence
ccggcgcaggacctgcc

SEQ ID NO: 6972 - DNA, 17 bp, Artificial sequence
  Synthesized sequence
atgacgcacggactgct

SEQ ID NO: 6973 - DNA, 17 bp, Artificial sequence
  Synthesized sequence
gtggcatcgccgaagcc

SEQ ID NO: 6974 - DNA, 17 bp, Artificial sequence
  Synthesized sequence
taggcaagtgcgctgcc

SEQ ID NO: 6975 - DNA, 17 bp, Artificial sequence
  Synthesized sequence
ctggccggcatgatggt

SEQ ID NO: 6976 - DNA, 17 bp, Artificial sequence
  Synthesized sequence
ctggctccccgcaggca

SEQ ID NO: 6977 - DNA, 17 bp, Artificial sequence
  Synthesized sequence
ggggcacgccgcatgag

SEQ ID NO: 6978 - DNA, 17 bp, Artificial sequence
  Synthesized sequence
atggcgcgcacggggcc

SEQ ID NO: 6979 - DNA, 17 bp, Artificial sequence
  Synthesized sequence
gcggcactggcccggca

SEQ ID NO: 6980 - DNA, 17 bp, Artificial sequence
  Synthesized sequence
tggtcaccgcccatgct

SEQ ID NO: 6981 - DNA, 17 bp, Artificial sequence
  Synthesized sequence
gtggaacagctgattcc

SEQ ID NO: 6982 - DNA, 17 bp, Artificial sequence
  Synthesized sequence
atggcgccggctctgtt

SEQ ID NO: 6983 - DNA, 17 bp, Artificial sequence
  Synthesized sequence
atgccaagtcgcctgcc

SEQ ID NO: 6984 - DNA, 17 bp, Artificial sequence
  Synthesized sequence
ctggaacagcgcctggc

SEQ ID NO: 6985 - DNA, 17 bp, Artificial sequence
  Synthesized sequence
ttgggacagccttatca

SEQ ID NO: 6986 - DNA, 17 bp, Artificial sequence
  Synthesized sequence
tggaaacgcctgttgcg

SEQ ID NO: 6987 - DNA, 17 bp, Artificial sequence
  Synthesized sequence
cgggcaggtcaatttcc

SEQ ID NO: 6988 - DNA, 17 bp, Artificial sequence
  Synthesized sequence
ttgggacggcgcttttc

SEQ ID NO: 6989 - DNA, 17 bp, Artificial sequence
  Synthesized sequence
accggacgacggttgcg

SEQ ID NO: 6990 - DNA, 17 bp, Artificial sequence
  Synthesized sequence
atggcctcgatcgagct

SEQ ID NO: 6991 - DNA, 17 bp, Artificial sequence
  Synthesized sequence
ctggctcacgaaattca

SEQ ID NO: 6992 - DNA, 17 bp, Artificial sequence
  Synthesized sequence
tgggcaatcgcgtcgca

SEQ ID NO: 6993 - DNA, 17 bp, Artificial sequence
  Synthesized sequence
gcggcaaggcgcgtgga

SEQ ID NO: 6994 - DNA, 17 bp, Artificial sequence
  Synthesized sequence
agggcctggcaactgcc

SEQ ID NO: 6995 - DNA, 17 bp, Artificial sequence
  Synthesized sequence
ctggccggagccgggca

SEQ ID NO: 6996 - DNA, 17 bp, Artificial sequence
  Synthesized sequence
cgggcatcggcctcgcc

SEQ ID NO: 6997 - DNA, 17 bp, Artificial sequence
  Synthesized sequence
atggccagcaggccgct

SEQ ID NO: 6998 - DNA, 17 bp, Artificial sequence
  Synthesized sequence
atggcgcgctgctggtg

SEQ ID NO: 6999 - DNA, 17 bp, Artificial sequence
  Synthesized sequence
tcggcgccagtgttgga

SEQ ID NO: 7000 - DNA, 17 bp, Artificial sequence
  Synthesized sequence
gcggcatgaggcgttct

SEQ ID NO: 7001 - DNA, 17 bp, Artificial sequence
  Synthesized sequence
caggcatgaaatgttct

SEQ ID NO: 7002 - DNA, 17 bp, Artificial sequence
  Synthesized sequence
tcggcaacgccctggcg

SEQ ID NO: 7003 - DNA, 17 bp, Artificial sequence
  Synthesized sequence
ccgcgacgcaccttgcg

SEQ ID NO: 7004 - DNA, 17 bp, Artificial sequence
  Synthesized sequence
ctgccccggtactttcg

SEQ ID NO: 7005 - DNA, 17 bp, Artificial sequence
  Synthesized sequence
ttgccacgaaatcagcg

SEQ ID NO: 7006 - DNA, 17 bp, Artificial sequence
  Synthesized sequence
atgtcgcgatcgctgcg

SEQ ID NO: 7007 - DNA, 17 bp, Artificial sequence
  Synthesized sequence
ccggcgcgcggctggcc

SEQ ID NO: 7008 - DNA, 17 bp, Artificial sequence
  Synthesized sequence
ttcgctggcgaattgcc

SEQ ID NO: 7009 - DNA, 17 bp, Artificial sequence
  Synthesized sequence
atggtcgggtatttcct

SEQ ID NO: 7010 - DNA, 17 bp, Artificial sequence
  Synthesized sequence
gtggcgatgcagtggcc

SEQ ID NO: 7011 - DNA, 17 bp, Artificial sequence
  Synthesized sequence
gcggcgaaggtcatgca

SEQ ID NO: 7012 - DNA, 17 bp, Artificial sequence
  Synthesized sequence
cgggcgctggcaatgca

SEQ ID NO: 7013 - DNA, 17 bp, Artificial sequence
  Synthesized sequence
gaagccgggcaattgct

SEQ ID NO: 7014 - DNA, 17 bp, Artificial sequence
  Synthesized sequence
ctggctggccgagcgct

SEQ ID NO: 7015 - DNA, 17 bp, Artificial sequence
  Synthesized sequence
ctggcaccccgccgact

SEQ ID NO: 7016 - DNA, 17 bp, Artificial sequence
  Synthesized sequence
cggtcacgtaggtcgct

SEQ ID NO: 7017 - DNA, 17 bp, Artificial sequence
  Synthesized sequence
gtggctggccaagcgca

SEQ ID NO: 7018 - DNA, 17 bp, Artificial sequence
  Synthesized sequence
ctggcctggtcgtagaa

SEQ ID NO: 7019 - DNA, 17 bp, Artificial sequence
  Synthesized sequence
ctggcccagagcatggc

SEQ ID NO: 7020 - DNA, 17 bp, Artificial sequence
  Synthesized sequence
atggcgcgcgagctggg

SEQ ID NO: 7021 - DNA, 17 bp, Artificial sequence
  Synthesized sequence
ggggaaggcaagctgca

SEQ ID NO: 7022 - DNA, 17 bp, Artificial sequence
  Synthesized sequence
ctggcgccgcacttcga

SEQ ID NO: 7023 - DNA, 17 bp, Artificial sequence
  Synthesized sequence
tgggcgcggtgatcgcc

SEQ ID NO: 7024 - DNA, 17 bp, Artificial sequence
  Synthesized sequence
ctggcagcaacccggcg

SEQ ID NO: 7025 - DNA, 17 bp, Artificial sequence
  Synthesized sequence
ctggcgcttctgtgggt

SEQ ID NO: 7026 - DNA, 17 bp, Artificial sequence
  Synthesized sequence
ttggcaaagtgttggag

SEQ ID NO: 7027 - DNA, 17 bp, Artificial sequence
  Synthesized sequence
gtggccagcccggcgca

SEQ ID NO: 7028 - DNA, 17 bp, Artificial sequence
  Synthesized sequence
ctggcccccggcaagca

SEQ ID NO: 7029 - DNA, 17 bp, Artificial sequence
  Synthesized sequence
ctggccttgttcaagct

SEQ ID NO: 7030 - DNA, 17 bp, Artificial sequence
  Synthesized sequence
aggggaagcgccgtgct

SEQ ID NO: 7031 - DNA, 17 bp, Artificial sequence
  Synthesized sequence
ctggcggtgccttcgcg

SEQ ID NO: 7032 - DNA, 17 bp, Artificial sequence
  Synthesized sequence
gcggcaccgccttcgaa

SEQ ID NO: 7033 - DNA, 17 bp, Artificial sequence
  Synthesized sequence
ttggctgacctcgcgct

SEQ ID NO: 7034 - DNA, 17 bp, Artificial sequence
  Synthesized sequence
ctggcacgacctcgccg

SEQ ID NO: 7035 - DNA, 17 bp, Artificial sequence
  Synthesized sequence
gttgcactgataaagca

SEQ ID NO: 7036 - DNA, 17 bp, Artificial sequence
  Synthesized sequence
ctggtggagatgtggca

SEQ ID NO: 7037 - DNA, 17 bp, Artificial sequence
  Synthesized sequence
atgggccgcatcctcct

SEQ ID NO: 7038 - DNA, 17 bp, Artificial sequence
  Synthesized sequence
tcgccagggctggtgca

SEQ ID NO: 7039 - DNA, 17 bp, Artificial sequence
  Synthesized sequence
ctggaagtcggcctgcg

SEQ ID NO: 7040 - DNA, 17 bp, Artificial sequence
  Synthesized sequence
ggggcgccgccgtagca

SEQ ID NO: 7041 - DNA, 17 bp, Artificial sequence
  Synthesized sequence
gtagcagagtctgtgcg

SEQ ID NO: 7042 - DNA, 17 bp, Artificial sequence
  Synthesized sequence
gcggcgttttttttgcc

SEQ ID NO: 7043 - DNA, 17 bp, Artificial sequence
  Synthesized sequence
gcggcgttttttttgcc

SEQ ID NO: 7044 - DNA, 17 bp, Artificial sequence
  Synthesized sequence
ctggcgctcggcctgtt

SEQ ID NO: 7045 - DNA, 17 bp, Artificial sequence
  Synthesized sequence
ctggccgaggagttccg

SEQ ID NO: 7046 - DNA, 17 bp, Artificial sequence
  Synthesized sequence
ggggcgaagatctcgct

SEQ ID NO: 7047 - DNA, 17 bp, Artificial sequence
  Synthesized sequence
gtggccctgctgcggcc

SEQ ID NO: 7048 - DNA, 17 bp, Artificial sequence
  Synthesized sequence
ctggcccggcgcttctc

SEQ ID NO: 7049 - DNA, 17 bp, Artificial sequence
  Synthesized sequence
atggcccagcgcgtggc

SEQ ID NO: 7050 - DNA, 17 bp, Artificial sequence
  Synthesized sequence
tcggcactgccaattct

SEQ ID NO: 7051 - DNA, 17 bp, Artificial sequence
  Synthesized sequence
ctgtcgcggtagtcgcg

SEQ ID NO: 7052 - DNA, 17 bp, Artificial sequence
  Synthesized sequence
ccggcccagtcctcgcc

SEQ ID NO: 7053 - DNA, 17 bp, Artificial sequence
  Synthesized sequence
atggagaggaaatttct

SEQ ID NO: 7054 - DNA, 17 bp, Artificial sequence
  Synthesized sequence
tgggcgcgatgatcgcc

SEQ ID NO: 7055 - DNA, 17 bp, Artificial sequence
  Synthesized sequence
ctggaacacggtgttca

SEQ ID NO: 7056 - DNA, 17 bp, Artificial sequence
  Synthesized sequence
ttggcggcgaaggtgcc

SEQ ID NO: 7057 - DNA, 17 bp, Artificial sequence
  Synthesized sequence
gtggccatcggcgtgcg

SEQ ID NO: 7058 - DNA, 17 bp, Artificial sequence
  Synthesized sequence
atcacccggcgcttgcg

SEQ ID NO: 7059 - DNA, 17 bp, Artificial sequence
  Synthesized sequence
ctggcgtgccttgcgcg

SEQ ID NO: 7060 - DNA, 17 bp, Artificial sequence
  Synthesized sequence
gtggcgtcggcatcgcc

SEQ ID NO: 7061 - DNA, 17 bp, Artificial sequence
  Synthesized sequence
ctggcctggctgctggc

SEQ ID NO: 7062 - DNA, 17 bp, Artificial sequence
  Synthesized sequence
ctgcaacgctgcctgcg

SEQ ID NO: 7063 - DNA, 17 bp, Artificial sequence
  Synthesized sequence
gcggtgcgcaagctgct

SEQ ID NO: 7064 - DNA, 17 bp, Artificial sequence
  Synthesized sequence
ctggcgtacatgctgat

SEQ ID NO: 7065 - DNA, 17 bp, Artificial sequence
  Synthesized sequence
ctcggccggctggtgct

SEQ ID NO: 7066 - DNA, 17 bp, Artificial sequence
  Synthesized sequence
ctggtcgatttcctgct

SEQ ID NO: 7067 - DNA, 17 bp, Artificial sequence
  Synthesized sequence
ctggttccggattttca

SEQ ID NO: 7068 - DNA, 17 bp, Artificial sequence
  Synthesized sequence
ggggcaggccacgggca

SEQ ID NO: 7069 - DNA, 17 bp, Artificial sequence
  Synthesized sequence
cgggctctcggcgtgct

SEQ ID NO: 7070 - DNA, 17 bp, Artificial sequence
  Synthesized sequence
atcgcgctgctcctgcg

SEQ ID NO: 7071 - DNA, 17 bp, Artificial sequence
  Synthesized sequence
atgccaccgacgccgct

SEQ ID NO: 7072 - DNA, 17 bp, Artificial sequence
  Synthesized sequence
aacgccggcctgttgct

SEQ ID NO: 7073 - DNA, 17 bp, Artificial sequence
  Synthesized sequence
ctgctgcgcgccttgcc

SEQ ID NO: 7074 - DNA, 17 bp, Artificial sequence
  Synthesized sequence
cgcgcaggcaggttgcc

SEQ ID NO: 7075 - DNA, 17 bp, Artificial sequence
  Synthesized sequence
atcgccctgacctggct

SEQ ID NO: 7076 - DNA, 17 bp, Artificial sequence
  Synthesized sequence
gttgcccggcagttggc

SEQ ID NO: 7077 - DNA, 17 bp, Artificial sequence
  Synthesized sequence
gtggcgctgggagtgat

SEQ ID NO: 7078 - DNA, 17 bp, Artificial sequence
  Synthesized sequence
ctggaaggccgaacgct

SEQ ID NO: 7079 - DNA, 17 bp, Artificial sequence
  Synthesized sequence
ctggaacgctactcggc

SEQ ID NO: 7080 - DNA, 17 bp, Artificial sequence
  Synthesized sequence
ctggatggagggctgct

SEQ ID NO: 7081 - DNA, 17 bp, Artificial sequence
  Synthesized sequence
ctggaacagtacatccg

SEQ ID NO: 7082 - DNA, 17 bp, Artificial sequence
  Synthesized sequence
caggcaaggaagatggt

SEQ ID NO: 7083 - DNA, 17 bp, Artificial sequence
  Synthesized sequence
atgacccatgtctggca

SEQ ID NO: 7084 - DNA, 17 bp, Artificial sequence
  Synthesized sequence
caggcacaccggtcgta

SEQ ID NO: 7085 - DNA, 17 bp, Artificial sequence
  Synthesized sequence
gtggtaccgcacctccg

SEQ ID NO: 7086 - DNA, 17 bp, Artificial sequence
  Synthesized sequence
ctgacctgcccgtcgct

SEQ ID NO: 7087 - DNA, 17 bp, Artificial sequence
  Synthesized sequence
ctggcgaggcgctcgta

SEQ ID NO: 7088 - DNA, 17 bp, Artificial sequence
  Synthesized sequence
gtagcgcgtggctggca

SEQ ID NO: 7089 - DNA, 17 bp, Artificial sequence
  Synthesized sequence
ctggcaggaaaccccct

SEQ ID NO: 7090 - DNA, 17 bp, Artificial sequence
  Synthesized sequence
agggcagcgcgctcgcg

SEQ ID NO: 7091 - DNA, 17 bp, Artificial sequence
  Synthesized sequence
gtggccctgctgatgag

SEQ ID NO: 7092 - DNA, 17 bp, Artificial sequence
  Synthesized sequence
ctggtcatccttctgct

SEQ ID NO: 7093 - DNA, 17 bp, Artificial sequence
  Synthesized sequence
ctggcgctgaccttcgt

SEQ ID NO: 7094 - DNA, 17 bp, Artificial sequence
  Synthesized sequence
acggcagacccgtcgcc

SEQ ID NO: 7095 - DNA, 17 bp, Artificial sequence
  Synthesized sequence
tccgcaccggtactgca

SEQ ID NO: 7096 - DNA, 17 bp, Artificial sequence
  Synthesized sequence
attgcccactgcttact

SEQ ID NO: 7097 - DNA, 17 bp, Artificial sequence
  Synthesized sequence
attgcccactgcttact

SEQ ID NO: 7098 - DNA, 17 bp, Artificial sequence
  Synthesized sequence
caggcgctgttcctgcg

SEQ ID NO: 7099 - DNA, 17 bp, Artificial sequence
  Synthesized sequence
gtcgcgcaccgcttcca

SEQ ID NO: 7100 - DNA, 17 bp, Artificial sequence
  Synthesized sequence
atcgcctacaacctgct

SEQ ID NO: 7101 - DNA, 17 bp, Artificial sequence
  Synthesized sequence
ctgcctccctgcctgct

SEQ ID NO: 7102 - DNA, 17 bp, Artificial sequence
  Synthesized sequence
cgggcccacgcgttcca

SEQ ID NO: 7103 - DNA, 17 bp, Artificial sequence
  Synthesized sequence
ccagcacacgaggtgct

SEQ ID NO: 7104 - DNA, 17 bp, Artificial sequence
  Synthesized sequence
caggaaggctcggtgct

SEQ ID NO: 7105 - DNA, 17 bp, Artificial sequence
  Synthesized sequence
atggagccgagcctgcc

SEQ ID NO: 7106 - DNA, 17 bp, Artificial sequence
  Synthesized sequence
atgagacacccgttgtt

SEQ ID NO: 7107 - DNA, 17 bp, Artificial sequence
  Synthesized sequence
ggagcacgagaatttca

SEQ ID NO: 7108 - DNA, 17 bp, Artificial sequence
  Synthesized sequence
cgggaattcctcctgct

SEQ ID NO: 7109 - DNA, 17 bp, Artificial sequence
  Synthesized sequence
ctggtggaggacgtgca

SEQ ID NO: 7110 - DNA, 17 bp, Artificial sequence
  Synthesized sequence
gcggcgaccaccttgcg

SEQ ID NO: 7111 - DNA, 17 bp, Artificial sequence
  Synthesized sequence
ctaacacgggcttcgca

SEQ ID NO: 7112 - DNA, 17 bp, Artificial sequence
  Synthesized sequence
tcggcgcgctggtggcg

SEQ ID NO: 7113 - DNA, 17 bp, Artificial sequence
  Synthesized sequence
ccggccgacctgctgct

SEQ ID NO: 7114 - DNA, 17 bp, Artificial sequence
  Synthesized sequence
caggcaccagacaggca

SEQ ID NO: 7115 - DNA, 17 bp, Artificial sequence
  Synthesized sequence
ctgggacaggtggtgac

SEQ ID NO: 7116 - DNA, 17 bp, Artificial sequence
  Synthesized sequence
ctgctcggccagttgct

SEQ ID NO: 7117 - DNA, 17 bp, Artificial sequence
  Synthesized sequence
cttgaacggcgatggcg

SEQ ID NO: 7118 - DNA, 17 bp, Artificial sequence
  Synthesized sequence
tcggcgcgcgcctggcg

SEQ ID NO: 7119 - DNA, 17 bp, Artificial sequence
  Synthesized sequence
ctggcgccaggtccgca

SEQ ID NO: 7120 - DNA, 17 bp, Artificial sequence
  Synthesized sequence
aaggcctacgccctgct

SEQ ID NO: 7121 - DNA, 17 bp, Artificial sequence
  Synthesized sequence
ctgccacggcgcctggc

SEQ ID NO: 7122 - DNA, 17 bp, Artificial sequence
  Synthesized sequence
gcggcgacgaccttgcc

SEQ ID NO: 7123 - DNA, 17 bp, Artificial sequence
  Synthesized sequence
ctggcgcatgggcttct

SEQ ID NO: 7124 - DNA, 17 bp, Artificial sequence
  Synthesized sequence
gtggcagacgccctggc

SEQ ID NO: 7125 - DNA, 17 bp, Artificial sequence
  Synthesized sequence
ctggttgatttcctgct

SEQ ID NO: 7126 - DNA, 17 bp, Artificial sequence
  Synthesized sequence
atggccaagcacctgga

SEQ ID NO: 7127 - DNA, 17 bp, Artificial sequence
  Synthesized sequence
ctcgatcggctgctgct

SEQ ID NO: 7128 - DNA, 17 bp, Artificial sequence
  Synthesized sequence
ctggtacctggcgcgca

SEQ ID NO: 7129 - DNA, 17 bp, Artificial sequence
  Synthesized sequence
ctcgaaagccacatgct

SEQ ID NO: 7130 - DNA, 17 bp, Artificial sequence
  Synthesized sequence
gcgggcttggtcttgct

SEQ ID NO: 7131 - DNA, 17 bp, Artificial sequence
  Synthesized sequence
gcgccccgcagcttgcg

SEQ ID NO: 7132 - DNA, 17 bp, Artificial sequence
  Synthesized sequence
ctggtggacgacgtgct

SEQ ID NO: 7133 - DNA, 17 bp, Artificial sequence
  Synthesized sequence
ctggcccagggccagcg

SEQ ID NO: 7134 - DNA, 17 bp, Artificial sequence
  Synthesized sequence
ttagcacactcgacgca

SEQ ID NO: 7135 - DNA, 17 bp, Artificial sequence
  Synthesized sequence
gcggcgcgcgcctggcc

SEQ ID NO: 7136 - DNA, 17 bp, Artificial sequence
  Synthesized sequence
ctggccggaaccctaca

SEQ ID NO: 7137 - DNA, 17 bp, Artificial sequence
  Synthesized sequence
acggcagcgccgctgcc

SEQ ID NO: 7138 - DNA, 17 bp, Artificial sequence
  Synthesized sequence
atgccggacagcttgcg

SEQ ID NO: 7139 - DNA, 17 bp, Artificial sequence
  Synthesized sequence
aaggcatcgacatcgcc

SEQ ID NO: 7140 - DNA, 17 bp, Artificial sequence
  Synthesized sequence
ctggcttgcggcgtcct

SEQ ID NO: 7141 - DNA, 17 bp, Artificial sequence
  Synthesized sequence
gcggcgcggtggttggc

SEQ ID NO: 7142 - DNA, 17 bp, Artificial sequence
  Synthesized sequence
tcggcgcggcagccgct

SEQ ID NO: 7143 - DNA, 17 bp, Artificial sequence
  Synthesized sequence
ttgccgccccattcgct

SEQ ID NO: 7144 - DNA, 17 bp, Artificial sequence
  Synthesized sequence
ccggcacatgatgggca

SEQ ID NO: 7145 - DNA, 17 bp, Artificial sequence
  Synthesized sequence
ctgggactgaacttcgt

SEQ ID NO: 7146 - DNA, 17 bp, Artificial sequence
  Synthesized sequence
gtggcccgagggctggg

SEQ ID NO: 7147 - DNA, 17 bp, Artificial sequence
  Synthesized sequence
gaggactacgccttgct

SEQ ID NO: 7148 - DNA, 17 bp, Artificial sequence
  Synthesized sequence
ttggagccgagcctgcc

SEQ ID NO: 7149 - DNA, 17 bp, Artificial sequence
  Synthesized sequence
gtgcgactatccctgca

SEQ ID NO: 7150 - DNA, 17 bp, Artificial sequence
  Synthesized sequence
ttggccacggcctcgcg

SEQ ID NO: 7151 - DNA, 17 bp, Artificial sequence
  Synthesized sequence
acgccaggctagttgcg

SEQ ID NO: 7152 - DNA, 17 bp, Artificial sequence
  Synthesized sequence
gggtcagggtgattgcc

SEQ ID NO: 7153 - DNA, 17 bp, Artificial sequence
  Synthesized sequence
gcggcacgctggaggcg

SEQ ID NO: 7154 - DNA, 17 bp, Artificial sequence
  Synthesized sequence
atcgagcggctggtgct

SEQ ID NO: 7155 - DNA, 17 bp, Artificial sequence
  Synthesized sequence
atggcgaggctcctggg

SEQ ID NO: 7156 - DNA, 17 bp, Artificial sequence
  Synthesized sequence
ctttcccgcctgttgcg

SEQ ID NO: 7157 - DNA, 17 bp, Artificial sequence
  Synthesized sequence
ctggtggacgacgtgct

SEQ ID NO: 7158 - DNA, 17 bp, Artificial sequence
  Synthesized sequence
caggtcgaccgcttgct

SEQ ID NO: 7159 - DNA, 17 bp, Artificial sequence
  Synthesized sequence
ctggcgctgctgaagcg

SEQ ID NO: 7160 - DNA, 17 bp, Artificial sequence
  Synthesized sequence
ttcgaccggcgcctgct

SEQ ID NO: 7161 - DNA, 17 bp, Artificial sequence
  Synthesized sequence
ctgccacggcctgcgcc

SEQ ID NO: 7162 - DNA, 17 bp, Artificial sequence
  Synthesized sequence
gttgcaggactgcggct

SEQ ID NO: 7163 - DNA, 17 bp, Artificial sequence
  Synthesized sequence
gaggcgctcccttagca

SEQ ID NO: 7164 - DNA, 17 bp, Artificial sequence
  Synthesized sequence
agggtaaagaccctgct

SEQ ID NO: 7165 - DNA, 17 bp, Artificial sequence
  Synthesized sequence
ccggaatcaagattgcg

SEQ ID NO: 7166 - DNA, 17 bp, Artificial sequence
  Synthesized sequence
ctggcgttgctggcgct

SEQ ID NO: 7167 - DNA, 17 bp, Artificial sequence
  Synthesized sequence
ctggccctgacctacca

SEQ ID NO: 7168 - DNA, 17 bp, Artificial sequence
  Synthesized sequence
ttggcgcttcctgcgca

SEQ ID NO: 7169 - DNA, 17 bp, Artificial sequence
  Synthesized sequence
ctggagccgggtttcct

SEQ ID NO: 7170 - DNA, 17 bp, Artificial sequence
  Synthesized sequence
aggggatggggctttct

SEQ ID NO: 7171 - DNA, 17 bp, Artificial sequence
  Synthesized sequence
atggcgcagagcacgcc

SEQ ID NO: 7172 - DNA, 17 bp, Artificial sequence
  Synthesized sequence
ctgccacgcctgctggc

SEQ ID NO: 7173 - DNA, 17 bp, Artificial sequence
  Synthesized sequence
atggttcgggcattccg

SEQ ID NO: 7174 - DNA, 17 bp, Artificial sequence
  Synthesized sequence
gtggcgggggtagagca

SEQ ID NO: 7175 - DNA, 17 bp, Artificial sequence
  Synthesized sequence
ggggcaaaccattcgcc

SEQ ID NO: 7176 - DNA, 17 bp, Artificial sequence
  Synthesized sequence
ggggcaaaccattcgcc

SEQ ID NO: 7177 - DNA, 17 bp, Artificial sequence
  Synthesized sequence
ttgccactcctgatgtt

SEQ ID NO: 7178 - DNA, 17 bp, Artificial sequence
  Synthesized sequence
tggtcggggctcttgca

SEQ ID NO: 7179 - DNA, 17 bp, Artificial sequence
  Synthesized sequence
gcggaacgtcgctggcg

SEQ ID NO: 7180 - DNA, 17 bp, Artificial sequence
  Synthesized sequence
tcgtcacgcacgttcca

SEQ ID NO: 7181 - DNA, 17 bp, Artificial sequence
  Synthesized sequence
ttcgccttgagcttgcc

SEQ ID NO: 7182 - DNA, 17 bp, Artificial sequence
  Synthesized sequence
cgggcgtgcccgtcgca

SEQ ID NO: 7183 - DNA, 17 bp, Artificial sequence
  Synthesized sequence
atggcgatgaggatgcg

SEQ ID NO: 7184 - DNA, 17 bp, Artificial sequence
  Synthesized sequence
atggaatggatcgtccg

SEQ ID NO: 7185 - DNA, 17 bp, Artificial sequence
  Synthesized sequence
gtggcatcgccctcacc

SEQ ID NO: 7186 - DNA, 17 bp, Artificial sequence
  Synthesized sequence
gtggaaggccggcggct

SEQ ID NO: 7187 - DNA, 17 bp, Artificial sequence
  Synthesized sequence
gccgaacgccaattgcg

SEQ ID NO: 7188 - DNA, 17 bp, Artificial sequence
  Synthesized sequence
ctggccctgctggagcg

SEQ ID NO: 7189 - DNA, 17 bp, Artificial sequence
  Synthesized sequence
aaggcacttatcaggca

SEQ ID NO: 7190 - DNA, 17 bp, Artificial sequence
  Synthesized sequence
cagggccgcctgctgca

SEQ ID NO: 7191 - DNA, 17 bp, Artificial sequence
  Synthesized sequence
gaggcacgatcactgac

SEQ ID NO: 7192 - DNA, 17 bp, Artificial sequence
  Synthesized sequence
ttggcgtggagatcgaa

SEQ ID NO: 7193 - DNA, 17 bp, Artificial sequence
  Synthesized sequence
tcggaatggtacctgcg

SEQ ID NO: 7194 - DNA, 17 bp, Artificial sequence
  Synthesized sequence
aagggaagcaccgtgca

SEQ ID NO: 7195 - DNA, 17 bp, Artificial sequence
  Synthesized sequence
atggcgcgcaggaagcc

SEQ ID NO: 7196 - DNA, 17 bp, Artificial sequence
  Synthesized sequence
gtgccgcgcttcttccg

SEQ ID NO: 7197 - DNA, 17 bp, Artificial sequence
  Synthesized sequence
ctggcctcgctgccgca

SEQ ID NO: 7198 - DNA, 17 bp, Artificial sequence
  Synthesized sequence
cgcgccctgccgttgct

SEQ ID NO: 7199 - DNA, 17 bp, Artificial sequence
  Synthesized sequence
gtggctgccaacctgcc

SEQ ID NO: 7200 - DNA, 17 bp, Artificial sequence
  Synthesized sequence
ctggacaaggccctgct

SEQ ID NO: 7201 - DNA, 17 bp, Artificial sequence
  Synthesized sequence
ccggcgcgctgttcgcc

SEQ ID NO: 7202 - DNA, 17 bp, Artificial sequence
  Synthesized sequence
ctgggtcgctattttcg

SEQ ID NO: 7203 - DNA, 17 bp, Artificial sequence
  Synthesized sequence
gaggaacgcaggtcgcc

SEQ ID NO: 7204 - DNA, 17 bp, Artificial sequence
  Synthesized sequence
gaggaacgcaggtcgcc

SEQ ID NO: 7205 - DNA, 17 bp, Artificial sequence
  Synthesized sequence
gaggcactcgtgaagca

SEQ ID NO: 7206 - DNA, 17 bp, Artificial sequence
  Synthesized sequence
gtggaaggcaacgggca

SEQ ID NO: 7207 - DNA, 17 bp, Artificial sequence
  Synthesized sequence
ctgggtgatgtattgcc

SEQ ID NO: 7208 - DNA, 17 bp, Artificial sequence
  Synthesized sequence
gtggcatggcggagact

SEQ ID NO: 7209 - DNA, 17 bp, Artificial sequence
  Synthesized sequence
ttggcggcgacctggcc

SEQ ID NO: 7210 - DNA, 17 bp, Artificial sequence
  Synthesized sequence
cgggccagggcggtgct

SEQ ID NO: 7211 - DNA, 17 bp, Artificial sequence
  Synthesized sequence
cgggccagggcggtgct

SEQ ID NO: 7212 - DNA, 17 bp, Artificial sequence
  Synthesized sequence
ctggggctttgtctgct

SEQ ID NO: 7213 - DNA, 17 bp, Artificial sequence
  Synthesized sequence
ccggcgctgggcttcct

SEQ ID NO: 7214 - DNA, 17 bp, Artificial sequence
  Synthesized sequence
ccggcgctgggcttcct

SEQ ID NO: 7215 - DNA, 17 bp, Artificial sequence
  Synthesized sequence
ctgggcttcctgctgct

SEQ ID NO: 7216 - DNA, 17 bp, Artificial sequence
  Synthesized sequence
ctgggcttcctgctgct

SEQ ID NO: 7217 - DNA, 17 bp, Artificial sequence
  Synthesized sequence
ccggctcggacatggcc

SEQ ID NO: 7218 - DNA, 17 bp, Artificial sequence
  Synthesized sequence
atggcatccagagcgcg

SEQ ID NO: 7219 - DNA, 17 bp, Artificial sequence
  Synthesized sequence
cagggctggcaattgcg

SEQ ID NO: 7220 - DNA, 17 bp, Artificial sequence
  Synthesized sequence
caggcggggcttttcca

SEQ ID NO: 7221 - DNA, 17 bp, Artificial sequence
  Synthesized sequence
gtagcagctctgtttct

SEQ ID NO: 7222 - DNA, 17 bp, Artificial sequence
  Synthesized sequence
gtagcagctctgtttct

SEQ ID NO: 7223 - DNA, 17 bp, Artificial sequence
  Synthesized sequence
ctggtaaacaatttccg

SEQ ID NO: 7224 - DNA, 17 bp, Artificial sequence
  Synthesized sequence
agggcattcaactggcc

SEQ ID NO: 7225 - DNA, 17 bp, Artificial sequence
  Synthesized sequence
ccggcatagatgatggt

SEQ ID NO: 7226 - DNA, 17 bp, Artificial sequence
  Synthesized sequence
gtggtgcacggtctgcc

SEQ ID NO: 7227 - DNA, 17 bp, Artificial sequence
  Synthesized sequence
ctgcaacgaccttggcg

SEQ ID NO: 7228 - DNA, 17 bp, Artificial sequence
  Synthesized sequence
atggcgacatccatgcc

SEQ ID NO: 7229 - DNA, 17 bp, Artificial sequence
  Synthesized sequence
agggtacgtagggtgcg

SEQ ID NO: 7230 - DNA, 17 bp, Artificial sequence
  Synthesized sequence
ctggctcaggcattcat

SEQ ID NO: 7231 - DNA, 17 bp, Artificial sequence
  Synthesized sequence
ctggcccagccgctgac

SEQ ID NO: 7232 - DNA, 17 bp, Artificial sequence
  Synthesized sequence
ccgcgaccggtgttgct

SEQ ID NO: 7233 - DNA, 17 bp, Artificial sequence
  Synthesized sequence
gctgccctggccttgct

SEQ ID NO: 7234 - DNA, 17 bp, Artificial sequence
  Synthesized sequence
ctcgccgggcgcctgca

SEQ ID NO: 7235 - DNA, 17 bp, Artificial sequence
  Synthesized sequence
ctcggcggcctgttgca

SEQ ID NO: 7236 - DNA, 17 bp, Artificial sequence
  Synthesized sequence
gtggctgaaatccggct

SEQ ID NO: 7237 - DNA, 17 bp, Artificial sequence
  Synthesized sequence
caggcggagatctggct

SEQ ID NO: 7238 - DNA, 17 bp, Artificial sequence
  Synthesized sequence
tgggatcgcctgctgca

SEQ ID NO: 7239 - DNA, 17 bp, Artificial sequence
  Synthesized sequence
ctggtagaaagcttccc

SEQ ID NO: 7240 - DNA, 17 bp, Artificial sequence
  Synthesized sequence
caggcctgagtgtttca

SEQ ID NO: 7241 - DNA, 17 bp, Artificial sequence
  Synthesized sequence
acggcctgacggttgga

SEQ ID NO: 7242 - DNA, 17 bp, Artificial sequence
  Synthesized sequence
ctgacgcgtaacctgcg

SEQ ID NO: 7243 - DNA, 17 bp, Artificial sequence
  Synthesized sequence
atcgcgaggtccatgct

SEQ ID NO: 7244 - DNA, 17 bp, Artificial sequence
  Synthesized sequence
gaggcttgcatgttgga

SEQ ID NO: 7245 - DNA, 17 bp, Artificial sequence
  Synthesized sequence
gaggcttgcatgttgga

SEQ ID NO: 7246 - DNA, 17 bp, Artificial sequence
  Synthesized sequence
ctggaaaggtgcgggca

SEQ ID NO: 7247 - DNA, 17 bp, Artificial sequence
  Synthesized sequence
agggcaggctcgttgac

SEQ ID NO: 7248 - DNA, 17 bp, Artificial sequence
  Synthesized sequence
ctaggacgtcgatttct

SEQ ID NO: 7249 - DNA, 17 bp, Artificial sequence
  Synthesized sequence
atgccacgaatagtgac

SEQ ID NO: 7250 - DNA, 17 bp, Artificial sequence
  Synthesized sequence
atgccacgaatagtgac

SEQ ID NO: 7251 - DNA, 17 bp, Artificial sequence
  Synthesized sequence
acggcaccgctcgcgcc

SEQ ID NO: 7252 - DNA, 17 bp, Artificial sequence
  Synthesized sequence
acggcaccgctcgcgcc

SEQ ID NO: 7253 - DNA, 17 bp, Artificial sequence
  Synthesized sequence
gtgacggggcttttgat

SEQ ID NO: 7254 - DNA, 17 bp, Artificial sequence
  Synthesized sequence
gtgacggggcttttgat

SEQ ID NO: 7255 - DNA, 17 bp, Artificial sequence
  Synthesized sequence
aaggcgtaacgggtgct

SEQ ID NO: 7256 - DNA, 17 bp, Artificial sequence
  Synthesized sequence
gcggctcgaattccgct

SEQ ID NO: 7257 - DNA, 17 bp, Artificial sequence
  Synthesized sequence
ctgggctaacgagtgca

SEQ ID NO: 7258 - DNA, 17 bp, Artificial sequence
  Synthesized sequence
atggtcgaacagatgca

SEQ ID NO: 7259 - DNA, 17 bp, Artificial sequence
  Synthesized sequence
ctgccgcccggcctgct

SEQ ID NO: 7260 - DNA, 17 bp, Artificial sequence
  Synthesized sequence
gtggaatcgatcccgca

SEQ ID NO: 7261 - DNA, 17 bp, Artificial sequence
  Synthesized sequence
ctggctgctcacctgcg

SEQ ID NO: 7262 - DNA, 17 bp, Artificial sequence
  Synthesized sequence
ctggcgaaagcttggcg

SEQ ID NO: 7263 - DNA, 17 bp, Artificial sequence
  Synthesized sequence
atgtcctggtcctcgca

SEQ ID NO: 7264 - DNA, 17 bp, Artificial sequence
  Synthesized sequence
ttggcaagacgattcgc

SEQ ID NO: 7265 - DNA, 17 bp, Artificial sequence
  Synthesized sequence
atcgtgcggttcgtgca

SEQ ID NO: 7266 - DNA, 17 bp, Artificial sequence
  Synthesized sequence
ttgcccgaggatttgcg

SEQ ID NO: 7267 - DNA, 17 bp, Artificial sequence
  Synthesized sequence
acggccctgaccctgcg

SEQ ID NO: 7268 - DNA, 17 bp, Artificial sequence
  Synthesized sequence
gtcgcctggcggtcgct

SEQ ID NO: 7269 - DNA, 17 bp, Artificial sequence
  Synthesized sequence
gtgaccctggcggtgct

SEQ ID NO: 7270 - DNA, 17 bp, Artificial sequence
  Synthesized sequence
gtggtacagagagcgcg

SEQ ID NO: 7271 - DNA, 17 bp, Artificial sequence
  Synthesized sequence
atggattactactcgct

SEQ ID NO: 7272 - DNA, 17 bp, Artificial sequence
  Synthesized sequence
ctggccctgctggcgcg

SEQ ID NO: 7273 - DNA, 17 bp, Artificial sequence
  Synthesized sequence
gtggccctgggcgtgga

SEQ ID NO: 7274 - DNA, 17 bp, Artificial sequence
  Synthesized sequence
ctgcaacccacctcgct

SEQ ID NO: 7275 - DNA, 17 bp, Artificial sequence
  Synthesized sequence
ctggtgctgaccctgcc

SEQ ID NO: 7276 - DNA, 17 bp, Artificial sequence
  Synthesized sequence
ccagcagggtttatgct

SEQ ID NO: 7277 - DNA, 17 bp, Artificial sequence
  Synthesized sequence
ccggcgcgccggtggcg

SEQ ID NO: 7278 - DNA, 17 bp, Artificial sequence
  Synthesized sequence
cgggcatgccatctaca

SEQ ID NO: 7279 - DNA, 17 bp, Artificial sequence
  Synthesized sequence
gtggatcgcctcgcgca

SEQ ID NO: 7280 - DNA, 17 bp, Artificial sequence
  Synthesized sequence
gggtcatggtactggct

SEQ ID NO: 7281 - DNA, 17 bp, Artificial sequence
  Synthesized sequence
ttggctacgcgctggcc

SEQ ID NO: 7282 - DNA, 17 bp, Artificial sequence
  Synthesized sequence
tcggcaagcgtcgagca

SEQ ID NO: 7283 - DNA, 17 bp, Artificial sequence
  Synthesized sequence
tcggcaagcgtcgagca

SEQ ID NO: 7284 - DNA, 17 bp, Artificial sequence
  Synthesized sequence
ctggaaactttcctgcc

SEQ ID NO: 7285 - DNA, 17 bp, Artificial sequence
  Synthesized sequence
ccggggcgacatctgct

SEQ ID NO: 7286 - DNA, 17 bp, Artificial sequence
  Synthesized sequence
gtggcaggattgccgtt

SEQ ID NO: 7287 - DNA, 17 bp, Artificial sequence
  Synthesized sequence
ctcgcacgggagttcgt

SEQ ID NO: 7288 - DNA, 17 bp, Artificial sequence
  Synthesized sequence
atggaatgatgaatgga

SEQ ID NO: 7289 - DNA, 17 bp, Artificial sequence
  Synthesized sequence
agggcatagggtttccg

SEQ ID NO: 7290 - DNA, 17 bp, Artificial sequence
  Synthesized sequence
ggggcattgctcccgct

SEQ ID NO: 7291 - DNA, 17 bp, Artificial sequence
  Synthesized sequence
ccggcacccggcgagct

SEQ ID NO: 7292 - DNA, 17 bp, Artificial sequence
  Synthesized sequence
ttgcccagttccttgcc

SEQ ID NO: 7293 - DNA, 17 bp, Artificial sequence
  Synthesized sequence
tcggcgacccccttgcg

SEQ ID NO: 7294 - DNA, 17 bp, Artificial sequence
  Synthesized sequence
tgggatcgactatcgct

SEQ ID NO: 7295 - DNA, 17 bp, Artificial sequence
  Synthesized sequence
ctggccctgcaatacct

SEQ ID NO: 7296 - DNA, 17 bp, Artificial sequence
  Synthesized sequence
gtgatcggagtcttgca

SEQ ID NO: 7297 - DNA, 17 bp, Artificial sequence
  Synthesized sequence
atcgacggacccttgca

SEQ ID NO: 7298 - DNA, 17 bp, Artificial sequence
  Synthesized sequence
agggcgcggagtttccc

SEQ ID NO: 7299 - DNA, 17 bp, Artificial sequence
  Synthesized sequence
ctggtcgaggccctgca

SEQ ID NO: 7300 - DNA, 17 bp, Artificial sequence
  Synthesized sequence
gtgccgaccgctttgca

SEQ ID NO: 7301 - DNA, 17 bp, Artificial sequence
  Synthesized sequence
gtgggacccgacattct

SEQ ID NO: 7302 - DNA, 17 bp, Artificial sequence
  Synthesized sequence
ctgggcaagaaggtgct

SEQ ID NO: 7303 - DNA, 17 bp, Artificial sequence
  Synthesized sequence
ctgggacagaacctccg

SEQ ID NO: 7304 - DNA, 17 bp, Artificial sequence
  Synthesized sequence
atgggaatgccgtcgcg

SEQ ID NO: 7305 - DNA, 17 bp, Artificial sequence
  Synthesized sequence
ctggcgggccacgtact

SEQ ID NO: 7306 - DNA, 17 bp, Artificial sequence
  Synthesized sequence
gtggcccggtgttgtcg

SEQ ID NO: 7307 - DNA, 17 bp, Artificial sequence
  Synthesized sequence
atgtcgcggaggatgcc

SEQ ID NO: 7308 - DNA, 17 bp, Artificial sequence
  Synthesized sequence
atggcgcgtctcttttc

SEQ ID NO: 7309 - DNA, 17 bp, Artificial sequence
  Synthesized sequence
gcggcagtgaaactgcc

SEQ ID NO: 7310 - DNA, 17 bp, Artificial sequence
  Synthesized sequence
ctggccgacaagttccg

SEQ ID NO: 7311 - DNA, 17 bp, Artificial sequence
  Synthesized sequence
atggtcaacgtggtgct

SEQ ID NO: 7312 - DNA, 17 bp, Artificial sequence
  Synthesized sequence
ttagcgctgcattagct

SEQ ID NO: 7313 - DNA, 17 bp, Artificial sequence
  Synthesized sequence
gcggaacgtcgctggcg

SEQ ID NO: 7314 - DNA, 17 bp, Artificial sequence
  Synthesized sequence
gcggcggcgcgtttgcg

SEQ ID NO: 7315 - DNA, 17 bp, Artificial sequence
  Synthesized sequence
gtgcctgtggcattgca

SEQ ID NO: 7316 - DNA, 17 bp, Artificial sequence
  Synthesized sequence
ttcggcgggcctttgca

SEQ ID NO: 7317 - DNA, 17 bp, Artificial sequence
  Synthesized sequence
ttcggcgggcctttgca

SEQ ID NO: 7318 - DNA, 17 bp, Artificial sequence
  Synthesized sequence
ggggcaggctcgtttcg

SEQ ID NO: 7319 - DNA, 17 bp, Artificial sequence
  Synthesized sequence
ttggcgctgtcgatgaa

SEQ ID NO: 7320 - DNA, 17 bp, Artificial sequence
  Synthesized sequence
acggcatgggcgcagca

SEQ ID NO: 7321 - DNA, 17 bp, Artificial sequence
  Synthesized sequence
ctggccgggctccagcc

SEQ ID NO: 7322 - DNA, 17 bp, Artificial sequence
  Synthesized sequence
ctgcaacgactgttccc

SEQ ID NO: 7323 - DNA, 17 bp, Artificial sequence
  Synthesized sequence
gtggaacaggaggggcg

SEQ ID NO: 7324 - DNA, 17 bp, Artificial sequence
  Synthesized sequence
gttgcgcgcggcctgcc

SEQ ID NO: 7325 - DNA, 17 bp, Artificial sequence
  Synthesized sequence
ctggcagcagaccggcg

SEQ ID NO: 7326 - DNA, 17 bp, Artificial sequence
  Synthesized sequence
ctggcgcgccgggtggc

SEQ ID NO: 7327 - DNA, 17 bp, Artificial sequence
  Synthesized sequence
ttggcaaggaggtatcc

SEQ ID NO: 7328 - DNA, 17 bp, Artificial sequence
  Synthesized sequence
atggccaggccctgcct

SEQ ID NO: 7329 - DNA, 17 bp, Artificial sequence
  Synthesized sequence
ctggcacaacggatcga

SEQ ID NO: 7330 - DNA, 17 bp, Artificial sequence
  Synthesized sequence
ctggccgacctgctgat

SEQ ID NO: 7331 - DNA, 17 bp, Artificial sequence
  Synthesized sequence
atggccgctgcgtggca

SEQ ID NO: 7332 - DNA, 17 bp, Artificial sequence
  Synthesized sequence
ctcgcaccagtccggca

SEQ ID NO: 7333 - DNA, 17 bp, Artificial sequence
  Synthesized sequence
tgggcaaacgcctggcg

SEQ ID NO: 7334 - DNA, 17 bp, Artificial sequence
  Synthesized sequence
atagcgcaccacctgcg

SEQ ID NO: 7335 - DNA, 17 bp, Artificial sequence
  Synthesized sequence
cgggcgcgtcattggcg

SEQ ID NO: 7336 - DNA, 17 bp, Artificial sequence
  Synthesized sequence
gcgacatgcgtcatgca

SEQ ID NO: 7337 - DNA, 17 bp, Artificial sequence
  Synthesized sequence
acggcttccgttttgcc

SEQ ID NO: 7338 - DNA, 17 bp, Artificial sequence
  Synthesized sequence
ttcgctcccgtactgca

SEQ ID NO: 7339 - DNA, 17 bp, Artificial sequence
  Synthesized sequence
tggggaccggcggtgca

SEQ ID NO: 7340 - DNA, 17 bp, Artificial sequence
  Synthesized sequence
attgcaccgttggtgat

SEQ ID NO: 7341 - DNA, 17 bp, Artificial sequence
  Synthesized sequence
ctggaacgtcggcagcg

SEQ ID NO: 7342 - DNA, 17 bp, Artificial sequence
  Synthesized sequence
aaggcgcgggcattggc

SEQ ID NO: 7343 - DNA, 17 bp, Artificial sequence
  Synthesized sequence
caggaccggggcgtgct

SEQ ID NO: 7344 - DNA, 17 bp, Artificial sequence
  Synthesized sequence
atggggcgcctgcggct

SEQ ID NO: 7345 - DNA, 17 bp, Artificial sequence
  Synthesized sequence
gcggccctggtgttgga

SEQ ID NO: 7346 - DNA, 17 bp, Artificial sequence
  Synthesized sequence
gttgtatttttcttgcg

SEQ ID NO: 7347 - DNA, 17 bp, Artificial sequence
  Synthesized sequence
ctcgtatgcgtattgat

SEQ ID NO: 7348 - DNA, 17 bp, Artificial sequence
  Synthesized sequence
ccggcacggagtctacc

SEQ ID NO: 7349 - DNA, 17 bp, Artificial sequence
  Synthesized sequence
ttgtaacggtttttgtc

SEQ ID NO: 7350 - DNA, 17 bp, Artificial sequence
  Synthesized sequence
caggtgcgcgacatgct

SEQ ID NO: 7351 - DNA, 17 bp, Artificial sequence
  Synthesized sequence
ttgctgcgggtcatgct

SEQ ID NO: 7352 - DNA, 17 bp, Artificial sequence
  Synthesized sequence
atgtcgccgcgcttggt

SEQ ID NO: 7353 - DNA, 17 bp, Artificial sequence
  Synthesized sequence
gcggcacgggccgtacc

SEQ ID NO: 7354 - DNA, 17 bp, Artificial sequence
  Synthesized sequence
atgcaaccgctcctgcc

SEQ ID NO: 7355 - DNA, 17 bp, Artificial sequence
  Synthesized sequence
ttggcgaggctgtccca

SEQ ID NO: 7356 - DNA, 17 bp, Artificial sequence
  Synthesized sequence
ctgcccctgacctggct

SEQ ID NO: 7357 - DNA, 17 bp, Artificial sequence
  Synthesized sequence
cctgcatggcctgtgca

SEQ ID NO: 7358 - DNA, 17 bp, Artificial sequence
  Synthesized sequence
ctggtgcggcagatggt

SEQ ID NO: 7359 - DNA, 17 bp, Artificial sequence
  Synthesized sequence
ctggcggcgccttggcg

SEQ ID NO: 7360 - DNA, 17 bp, Artificial sequence
  Synthesized sequence
ctggccgggcgggtgga

SEQ ID NO: 7361 - DNA, 17 bp, Artificial sequence
  Synthesized sequence
caggctgcgcagttgcg

SEQ ID NO: 7362 - DNA, 17 bp, Artificial sequence
  Synthesized sequence
ctggcgggcgagccgct

SEQ ID NO: 7363 - DNA, 17 bp, Artificial sequence
  Synthesized sequence
ctggcactgatgggaca

SEQ ID NO: 7364 - DNA, 17 bp, Artificial sequence
  Synthesized sequence
ctggagtgccccatgcc

SEQ ID NO: 7365 - DNA, 17 bp, Artificial sequence
  Synthesized sequence
gtgccacggcgcctgac

SEQ ID NO: 7366 - DNA, 17 bp, Artificial sequence
  Synthesized sequence
atggcgtggggagttct

SEQ ID NO: 7367 - DNA, 17 bp, Artificial sequence
  Synthesized sequence
ctggtcaatctgctgca

SEQ ID NO: 7368 - DNA, 17 bp, Artificial sequence
  Synthesized sequence
ttggccagggcgaagct

SEQ ID NO: 7369 - DNA, 17 bp, Artificial sequence
  Synthesized sequence
ctggacgactccctgct

SEQ ID NO: 7370 - DNA, 17 bp, Artificial sequence
  Synthesized sequence
tcggcgttcctcctgct

SEQ ID NO: 7371 - DNA, 17 bp, Artificial sequence
  Synthesized sequence
gtgctgcagcagttgcc

SEQ ID NO: 7372 - DNA, 17 bp, Artificial sequence
  Synthesized sequence
ttgccatggataatcct

SEQ ID NO: 7373 - DNA, 17 bp, Artificial sequence
  Synthesized sequence
ctggcccggcagttcac

SEQ ID NO: 7374 - DNA, 17 bp, Artificial sequence
  Synthesized sequence
gtggcacaaggacgcca

SEQ ID NO: 7375 - DNA, 17 bp, Artificial sequence
  Synthesized sequence
gtggcgccctgggtggt

SEQ ID NO: 7376 - DNA, 17 bp, Artificial sequence
  Synthesized sequence
ctgaccgggccctggct

SEQ ID NO: 7377 - DNA, 17 bp, Artificial sequence
  Synthesized sequence
gtggtgccgcgctcgcg

SEQ ID NO: 7378 - DNA, 17 bp, Artificial sequence
  Synthesized sequence
ctgacgcgcgggttgaa

SEQ ID NO: 7379 - DNA, 17 bp, Artificial sequence
  Synthesized sequence
ctggccaacctcgagca

SEQ ID NO: 7380 - DNA, 17 bp, Artificial sequence
  Synthesized sequence
ctggtcgcactgctgct

SEQ ID NO: 7381 - DNA, 17 bp, Artificial sequence
  Synthesized sequence
attgcaagtcggctgcc

SEQ ID NO: 7382 - DNA, 17 bp, Artificial sequence
  Synthesized sequence
ttggcctggcgccggcg

SEQ ID NO: 7383 - DNA, 17 bp, Artificial sequence
  Synthesized sequence
ccggcccacgacctgcc

SEQ ID NO: 7384 - DNA, 17 bp, Artificial sequence
  Synthesized sequence
gaggaaacctttttgcc

SEQ ID NO: 7385 - DNA, 17 bp, Artificial sequence
  Synthesized sequence
attgcagggctaccgca

SEQ ID NO: 7386 - DNA, 17 bp, Artificial sequence
  Synthesized sequence
acggcaggtagctttcc

SEQ ID NO: 7387 - DNA, 17 bp, Artificial sequence
  Synthesized sequence
gtgggcgagaacctgca

SEQ ID NO: 7388 - DNA, 17 bp, Artificial sequence
  Synthesized sequence
tcggcaggagcatttcc

SEQ ID NO: 7389 - DNA, 17 bp, Artificial sequence
  Synthesized sequence
ggggcccggctcatcct

SEQ ID NO: 7390 - DNA, 17 bp, Artificial sequence
  Synthesized sequence
ctggccctggggctgaa

SEQ ID NO: 7391 - DNA, 17 bp, Artificial sequence
  Synthesized sequence
ctggtgcgatatcggct

SEQ ID NO: 7392 - DNA, 17 bp, Artificial sequence
  Synthesized sequence
gcggagggccagttgca

SEQ ID NO: 7393 - DNA, 17 bp, Artificial sequence
  Synthesized sequence
atgccattcgtttttca

SEQ ID NO: 7394 - DNA, 17 bp, Artificial sequence
  Synthesized sequence
ctcgccggcctgtcgct

SEQ ID NO: 7395 - DNA, 17 bp, Artificial sequence
  Synthesized sequence
ctggaatgcgcggcgca

SEQ ID NO: 7396 - DNA, 17 bp, Artificial sequence
  Synthesized sequence
ctggccagcgtagttct

SEQ ID NO: 7397 - DNA, 17 bp, Artificial sequence
  Synthesized sequence
gtggcgcagcgcgttcg

SEQ ID NO: 7398 - DNA, 17 bp, Artificial sequence
  Synthesized sequence
cgggcacggatgtgacg

SEQ ID NO: 7399 - DNA, 17 bp, Artificial sequence
  Synthesized sequence
ctggccgccgtctcgcc

SEQ ID NO: 7400 - DNA, 17 bp, Artificial sequence
  Synthesized sequence
atggaacagctctatcc

SEQ ID NO: 7401 - DNA, 17 bp, Artificial sequence
  Synthesized sequence
agggcatcggcctggcc

SEQ ID NO: 7402 - DNA, 17 bp, Artificial sequence
  Synthesized sequence
ttgggtgaactgtcgct

SEQ ID NO: 7403 - DNA, 17 bp, Artificial sequence
  Synthesized sequence
gtcgagcggctgctgca

SEQ ID NO: 7404 - DNA, 17 bp, Artificial sequence
  Synthesized sequence
gtggtcaaggaaatgct

SEQ ID NO: 7405 - DNA, 17 bp, Artificial sequence
  Synthesized sequence
tgggaacgcaagtcgcc

SEQ ID NO: 7406 - DNA, 17 bp, Artificial sequence
  Synthesized sequence
ctggcgcagttgctggc

SEQ ID NO: 7407 - DNA, 17 bp, Artificial sequence
  Synthesized sequence
ctggcgcaacaggagcg

SEQ ID NO: 7408 - DNA, 17 bp, Artificial sequence
  Synthesized sequence
ctggaggagcatctgca

SEQ ID NO: 7409 - DNA, 17 bp, Artificial sequence
  Synthesized sequence
ctgtaccgcgaattgcg

SEQ ID NO: 7410 - DNA, 17 bp, Artificial sequence
  Synthesized sequence
ccggaacccggctcgct

SEQ ID NO: 7411 - DNA, 17 bp, Artificial sequence
  Synthesized sequence
gaggcgcgggtcgagct

SEQ ID NO: 7412 - DNA, 17 bp, Artificial sequence
  Synthesized sequence
gcggcagcgccgctgcc

SEQ ID NO: 7413 - DNA, 17 bp, Artificial sequence
  Synthesized sequence
caggtgcgaagcatgct

SEQ ID NO: 7414 - DNA, 17 bp, Artificial sequence
  Synthesized sequence
gtcgcgctgttcttcct

SEQ ID NO: 7415 - DNA, 17 bp, Artificial sequence
  Synthesized sequence
ctcgaccggcgcctgct

SEQ ID NO: 7416 - DNA, 17 bp, Artificial sequence
  Synthesized sequence
gcgcctcgacgcttgcc

SEQ ID NO: 7417 - DNA, 17 bp, Artificial sequence
  Synthesized sequence
gaggtccgaaacctgca

SEQ ID NO: 7418 - DNA, 17 bp, Artificial sequence
  Synthesized sequence
ctgacccgcccgtcgcg

SEQ ID NO: 7419 - DNA, 17 bp, Artificial sequence
  Synthesized sequence
ccggcgaggaactggca

SEQ ID NO: 7420 - DNA, 17 bp, Artificial sequence
  Synthesized sequence
ttggcttcgctcatgat

SEQ ID NO: 7421 - DNA, 17 bp, Artificial sequence
  Synthesized sequence
ttgacccggccatggcg

SEQ ID NO: 7422 - DNA, 17 bp, Artificial sequence
  Synthesized sequence
ggggccggcaaggtgct

SEQ ID NO: 7423 - DNA, 17 bp, Artificial sequence
  Synthesized sequence
tcggcggataccttgcc

SEQ ID NO: 7424 - DNA, 17 bp, Artificial sequence
  Synthesized sequence
atggccaagctgctggt

SEQ ID NO: 7425 - DNA, 17 bp, Artificial sequence
  Synthesized sequence
cctgcacgtcagttcct

SEQ ID NO: 7426 - DNA, 17 bp, Artificial sequence
  Synthesized sequence
tctgcaccagtcatgca

SEQ ID NO: 7427 - DNA, 17 bp, Artificial sequence
  Synthesized sequence
ctggggcggcaactggt

SEQ ID NO: 7428 - DNA, 17 bp, Artificial sequence
  Synthesized sequence
cggacgggaatcttgct

SEQ ID NO: 7429 - DNA, 17 bp, Artificial sequence
  Synthesized sequence
ttgcctctctccatgct

SEQ ID NO: 7430 - DNA, 17 bp, Artificial sequence
  Synthesized sequence
gcggcacgcgccaagcg

SEQ ID NO: 7431 - DNA, 17 bp, Artificial sequence
  Synthesized sequence
ctggccggcgccgcgct

SEQ ID NO: 7432 - DNA, 17 bp, Artificial sequence
  Synthesized sequence
ctggcggcagtggtgcc

SEQ ID NO: 7433 - DNA, 17 bp, Artificial sequence
  Synthesized sequence
ccggcccggtgatggcc

SEQ ID NO: 7434 - DNA, 17 bp, Artificial sequence
  Synthesized sequence
ccggcatcatcactgcc

SEQ ID NO: 7435 - DNA, 17 bp, Artificial sequence
  Synthesized sequence
gtggcgcgcaattcccg

SEQ ID NO: 7436 - DNA, 17 bp, Artificial sequence
  Synthesized sequence
ttgcgaccgagggtgct

SEQ ID NO: 7437 - DNA, 17 bp, Artificial sequence
  Synthesized sequence
gttgcgctaccttcgct

SEQ ID NO: 7438 - DNA, 17 bp, Artificial sequence
  Synthesized sequence
caggctcgcgtgtggcg

SEQ ID NO: 7439 - DNA, 17 bp, Artificial sequence
  Synthesized sequence
tcggccaggcgatagct

SEQ ID NO: 7440 - DNA, 17 bp, Artificial sequence
  Synthesized sequence
tcggcaccaggccagca

SEQ ID NO: 7441 - DNA, 17 bp, Artificial sequence
  Synthesized sequence
ctgggttggcggctgcg

SEQ ID NO: 7442 - DNA, 17 bp, Artificial sequence
  Synthesized sequence
atggcgcccgaactgat

SEQ ID NO: 7443 - DNA, 17 bp, Artificial sequence
  Synthesized sequence
gaggccctgctggtgcc

SEQ ID NO: 7444 - DNA, 17 bp, Artificial sequence
  Synthesized sequence
ggtgccgggcatttgct

SEQ ID NO: 7445 - DNA, 17 bp, Artificial sequence
  Synthesized sequence
ggtgccgggcatttgct

SEQ ID NO: 7446 - DNA, 17 bp, Artificial sequence
  Synthesized sequence
ctggcaccacctggtct

SEQ ID NO: 7447 - DNA, 17 bp, Artificial sequence
  Synthesized sequence
ctgccggcgctattgcc

SEQ ID NO: 7448 - DNA, 17 bp, Artificial sequence
  Synthesized sequence
caggccggcggcctgct

SEQ ID NO: 7449 - DNA, 17 bp, Artificial sequence
  Synthesized sequence
atggcgcagatctggac

SEQ ID NO: 7450 - DNA, 17 bp, Artificial sequence
  Synthesized sequence
atggcgcagatctggac

SEQ ID NO: 7451 - DNA, 17 bp, Artificial sequence
  Synthesized sequence
ttggcggggcttttttt

SEQ ID NO: 7452 - DNA, 17 bp, Artificial sequence
  Synthesized sequence
ctggcagaagggccgcg

SEQ ID NO: 7453 - DNA, 17 bp, Artificial sequence
  Synthesized sequence
ttcgcacgaatcgttcc

SEQ ID NO: 7454 - DNA, 17 bp, Artificial sequence
  Synthesized sequence
gcggcccgcgcttcgcc

SEQ ID NO: 7455 - DNA, 17 bp, Artificial sequence
  Synthesized sequence
tagggaaagcccatgca

SEQ ID NO: 7456 - DNA, 17 bp, Artificial sequence
  Synthesized sequence
ggggcatggcgttcggt

SEQ ID NO: 7457 - DNA, 17 bp, Artificial sequence
  Synthesized sequence
acggcttgcgcctcgca

SEQ ID NO: 7458 - DNA, 17 bp, Artificial sequence
  Synthesized sequence
aaggcactcgcccggca

SEQ ID NO: 7459 - DNA, 17 bp, Artificial sequence
  Synthesized sequence
ctggcactgaaggggga

SEQ ID NO: 7460 - DNA, 17 bp, Artificial sequence
  Synthesized sequence
gtgggcgggtctttgaa

SEQ ID NO: 7461 - DNA, 17 bp, Artificial sequence
  Synthesized sequence
atggaagaaagatggcg

SEQ ID NO: 7462 - DNA, 17 bp, Artificial sequence
  Synthesized sequence
gaggaaagcgccatgca

SEQ ID NO: 7463 - DNA, 17 bp, Artificial sequence
  Synthesized sequence
ctggcccgcctcccgaa

SEQ ID NO: 7464 - DNA, 17 bp, Artificial sequence
  Synthesized sequence
ctggcccgcctcccgaa

SEQ ID NO: 7465 - DNA, 17 bp, Artificial sequence
  Synthesized sequence
cagggacgcccgtttcg

SEQ ID NO: 7466 - DNA, 17 bp, Artificial sequence
  Synthesized sequence
ggtgcacgacgtgtgcg

SEQ ID NO: 7467 - DNA, 17 bp, Artificial sequence
  Synthesized sequence
caggcaccggagatgat

SEQ ID NO: 7468 - DNA, 17 bp, Artificial sequence
  Synthesized sequence
ttggaaaaggagttgac

SEQ ID NO: 7469 - DNA, 17 bp, Artificial sequence
  Synthesized sequence
atggaagtgatgttgag

SEQ ID NO: 7470 - DNA, 17 bp, Artificial sequence
  Synthesized sequence
ttcgactgcgacttgca

SEQ ID NO: 7471 - DNA, 17 bp, Artificial sequence
  Synthesized sequence
ggagcctgccatttgct

SEQ ID NO: 7472 - DNA, 17 bp, Artificial sequence
  Synthesized sequence
tttgcacggatagtccg

SEQ ID NO: 7473 - DNA, 17 bp, Artificial sequence
  Synthesized sequence
aaggcgccagcctagca

SEQ ID NO: 7474 - DNA, 17 bp, Artificial sequence
  Synthesized sequence
ggcgaacaggcgttgca

SEQ ID NO: 7475 - DNA, 17 bp, Artificial sequence
  Synthesized sequence
atggctccgggaatgtt

SEQ ID NO: 7476 - DNA, 17 bp, Artificial sequence
  Synthesized sequence
ccggaactgctggtgcc

SEQ ID NO: 7477 - DNA, 17 bp, Artificial sequence
  Synthesized sequence
ttcgaaacagggttgca

SEQ ID NO: 7478 - DNA, 17 bp, Artificial sequence
  Synthesized sequence
atggcagcaggttaggt

SEQ ID NO: 7479 - DNA, 17 bp, Artificial sequence
  Synthesized sequence
gaggagcgcatggtgct

SEQ ID NO: 7480 - DNA, 17 bp, Artificial sequence
  Synthesized sequence
ctggctggtctggcgca

SEQ ID NO: 7481 - DNA, 17 bp, Artificial sequence
  Synthesized sequence
caggttcaactcctgct

SEQ ID NO: 7482 - DNA, 17 bp, Artificial sequence
  Synthesized sequence
ctggcggggcgagcgca

SEQ ID NO: 7483 - DNA, 17 bp, Artificial sequence
  Synthesized sequence
gcggtatggcgtctgcc

SEQ ID NO: 7484 - DNA, 17 bp, Artificial sequence
  Synthesized sequence
atggcgtctgccgtgcg

SEQ ID NO: 7485 - DNA, 17 bp, Artificial sequence
  Synthesized sequence
tcgccacggtcgatgcg

SEQ ID NO: 7486 - DNA, 17 bp, Artificial sequence
  Synthesized sequence
tcggcggcgtccttgcc

SEQ ID NO: 7487 - DNA, 17 bp, Artificial sequence
  Synthesized sequence
gtggtccgccgccagct

SEQ ID NO: 7488 - DNA, 17 bp, Artificial sequence
  Synthesized sequence
ctggccggcgagccgct

SEQ ID NO: 7489 - DNA, 17 bp, Artificial sequence
  Synthesized sequence
gaggagcagatcctgct

SEQ ID NO: 7490 - DNA, 17 bp, Artificial sequence
  Synthesized sequence
ttgacgcgccgctggcg

SEQ ID NO: 7491 - DNA, 17 bp, Artificial sequence
  Synthesized sequence
ttgacgcgccgctggcg

SEQ ID NO: 7492 - DNA, 17 bp, Artificial sequence
  Synthesized sequence
gtgacgctgctgttcct

SEQ ID NO: 7493 - DNA, 17 bp, Artificial sequence
  Synthesized sequence
gtggcccaggtgctggc

SEQ ID NO: 7494 - DNA, 17 bp, Artificial sequence
  Synthesized sequence
cctgcccgccgcttgcc

SEQ ID NO: 7495 - DNA, 17 bp, Artificial sequence
  Synthesized sequence
ccggcgcgatggtcgcc

SEQ ID NO: 7496 - DNA, 17 bp, Artificial sequence
  Synthesized sequence
ctggtgctggcgttgta

SEQ ID NO: 7497 - DNA, 17 bp, Artificial sequence
  Synthesized sequence
ctggcgctgctggcgcc

SEQ ID NO: 7498 - DNA, 17 bp, Artificial sequence
  Synthesized sequence
gcggcatcgccgtggcc

SEQ ID NO: 7499 - DNA, 17 bp, Artificial sequence
  Synthesized sequence
atggcgtcggcttcgcc

SEQ ID NO: 7500 - DNA, 17 bp, Artificial sequence
  Synthesized sequence
tcggcctggaccctgcg

SEQ ID NO: 7501 - DNA, 17 bp, Artificial sequence
  Synthesized sequence
tcgccacgctcattcca

SEQ ID NO: 7502 - DNA, 17 bp, Artificial sequence
  Synthesized sequence
ctcgcacaacgctggat

SEQ ID NO: 7503 - DNA, 17 bp, Artificial sequence
  Synthesized sequence
ctggcacgtgcagccca

SEQ ID NO: 7504 - DNA, 17 bp, Artificial sequence
  Synthesized sequence
ctggtcctgatgtcgcc

SEQ ID NO: 7505 - DNA, 17 bp, Artificial sequence
  Synthesized sequence
gtggagatgtggttgcc

SEQ ID NO: 7506 - DNA, 17 bp, Artificial sequence
  Synthesized sequence
gtggagatgtggttgcc

SEQ ID NO: 7507 - DNA, 17 bp, Artificial sequence
  Synthesized sequence
ctggtgcccgtcgtgcc

SEQ ID NO: 7508 - DNA, 17 bp, Artificial sequence
  Synthesized sequence
ccggagcgccgcctgct

SEQ ID NO: 7509 - DNA, 17 bp, Artificial sequence
  Synthesized sequence
atgggccgcatcctggt

SEQ ID NO: 7510 - DNA, 17 bp, Artificial sequence
  Synthesized sequence
ctggcctggctgctggg

SEQ ID NO: 7511 - DNA, 17 bp, Artificial sequence
  Synthesized sequence
atggcctccctcgcgca

SEQ ID NO: 7512 - DNA, 17 bp, Artificial sequence
  Synthesized sequence
ctggcccagcgcatggc

SEQ ID NO: 7513 - DNA, 17 bp, Artificial sequence
  Synthesized sequence
ctggaaaaccagttggc

SEQ ID NO: 7514 - DNA, 17 bp, Artificial sequence
  Synthesized sequence
atgtcgctggtcttggt

SEQ ID NO: 7515 - DNA, 17 bp, Artificial sequence
  Synthesized sequence
ctcgcaccttgcttgag

SEQ ID NO: 7516 - DNA, 17 bp, Artificial sequence
  Synthesized sequence
caggcacaccggtcgta

SEQ ID NO: 7517 - DNA, 17 bp, Artificial sequence
  Synthesized sequence
gtggtaccgcacctccg

SEQ ID NO: 7518 - DNA, 17 bp, Artificial sequence
  Synthesized sequence
ctgggacccggccagca

SEQ ID NO: 7519 - DNA, 17 bp, Artificial sequence
  Synthesized sequence
atgccatggccggggca

SEQ ID NO: 7520 - DNA, 17 bp, Artificial sequence
  Synthesized sequence
aaggaatatcgcctgct

SEQ ID NO: 7521 - DNA, 17 bp, Artificial sequence
  Synthesized sequence
atggacccgaaggtgcg

SEQ ID NO: 7522 - DNA, 17 bp, Artificial sequence
  Synthesized sequence
cgggcccggcgccggct

SEQ ID NO: 7523 - DNA, 17 bp, Artificial sequence
  Synthesized sequence
ccggctcgaagctggcc

SEQ ID NO: 7524 - DNA, 17 bp, Artificial sequence
  Synthesized sequence
attggccgacttgtgct

SEQ ID NO: 7525 - DNA, 17 bp, Artificial sequence
  Synthesized sequence
cggggacgccatttacg

SEQ ID NO: 7526 - DNA, 17 bp, Artificial sequence
  Synthesized sequence
aagggacacctgtcgcc

SEQ ID NO: 7527 - DNA, 17 bp, Artificial sequence
  Synthesized sequence
ctggcgcagcggctggc

SEQ ID NO: 7528 - DNA, 17 bp, Artificial sequence
  Synthesized sequence
ctggctgggcgaaagca

SEQ ID NO: 7529 - DNA, 17 bp, Artificial sequence
  Synthesized sequence
gtggaaaccgtgtcgcg

SEQ ID NO: 7530 - DNA, 17 bp, Artificial sequence
  Synthesized sequence
attgaggggtccttgct

SEQ ID NO: 7531 - DNA, 17 bp, Artificial sequence
  Synthesized sequence
ctgacaggccgatggcg

SEQ ID NO: 7532 - DNA, 17 bp, Artificial sequence
  Synthesized sequence
ctggtgcagactttccg

SEQ ID NO: 7533 - DNA, 17 bp, Artificial sequence
  Synthesized sequence
ctggtgcagactttccg

SEQ ID NO: 7534 - DNA, 17 bp, Artificial sequence
  Synthesized sequence
aaggcgcgcggctggcg

SEQ ID NO: 7535 - DNA, 17 bp, Artificial sequence
  Synthesized sequence
ctggtagagaacaagct

SEQ ID NO: 7536 - DNA, 17 bp, Artificial sequence
  Synthesized sequence
ggcgcaccgtgcgtgct

SEQ ID NO: 7537 - DNA, 17 bp, Artificial sequence
  Synthesized sequence
aaggcccgatgatggcg

SEQ ID NO: 7538 - DNA, 17 bp, Artificial sequence
  Synthesized sequence
aaggcccgatgatggcg

SEQ ID NO: 7539 - DNA, 17 bp, Artificial sequence
  Synthesized sequence
gtggcgggctatgcgct

SEQ ID NO: 7540 - DNA, 17 bp, Artificial sequence
  Synthesized sequence
ctggcactgcgggcgga

SEQ ID NO: 7541 - DNA, 17 bp, Artificial sequence
  Synthesized sequence
ctgccaggcctccggca

SEQ ID NO: 7542 - DNA, 17 bp, Artificial sequence
  Synthesized sequence
atggcggagaacctgat

SEQ ID NO: 7543 - DNA, 17 bp, Artificial sequence
  Synthesized sequence
ttggagcaggaatggcg

SEQ ID NO: 7544 - DNA, 17 bp, Artificial sequence
  Synthesized sequence
acgggacgaagatcgcc

SEQ ID NO: 7545 - DNA, 17 bp, Artificial sequence
  Synthesized sequence
ctggccaagctggtgat

SEQ ID NO: 7546 - DNA, 17 bp, Artificial sequence
  Synthesized sequence
gtgccacaccctgtact

SEQ ID NO: 7547 - DNA, 17 bp, Artificial sequence
  Synthesized sequence
caggaaaaactgctgca

SEQ ID NO: 7548 - DNA, 17 bp, Artificial sequence
  Synthesized sequence
gtggttccggtactgcg

SEQ ID NO: 7549 - DNA, 17 bp, Artificial sequence
  Synthesized sequence
gtggctccggtttgtct

SEQ ID NO: 7550 - DNA, 17 bp, Artificial sequence
  Synthesized sequence
ttggccccaggggtggt

SEQ ID NO: 7551 - DNA, 17 bp, Artificial sequence
  Synthesized sequence
tcggcccagtcctggcg

SEQ ID NO: 7552 - DNA, 17 bp, Artificial sequence
  Synthesized sequence
caggcccggatcgtcct

SEQ ID NO: 7553 - DNA, 17 bp, Artificial sequence
  Synthesized sequence
ctggtgccccgcctgcc

SEQ ID NO: 7554 - DNA, 17 bp, Artificial sequence
  Synthesized sequence
atggactgccgcctgcc

SEQ ID NO: 7555 - DNA, 17 bp, Artificial sequence
  Synthesized sequence
gaggcactgggcctggt

SEQ ID NO: 7556 - DNA, 17 bp, Artificial sequence
  Synthesized sequence
agggcaagtacgtggcg

SEQ ID NO: 7557 - DNA, 17 bp, Artificial sequence
  Synthesized sequence
ctggcatcagccctgtc

SEQ ID NO: 7558 - DNA, 17 bp, Artificial sequence
  Synthesized sequence
ctggccggaagtgcgca

SEQ ID NO: 7559 - DNA, 17 bp, Artificial sequence
  Synthesized sequence
ctggtcttcaccctgct

SEQ ID NO: 7560 - DNA, 17 bp, Artificial sequence
  Synthesized sequence
acggcgcgcgggctgcc

SEQ ID NO: 7561 - DNA, 17 bp, Artificial sequence
  Synthesized sequence
gcggtcggcccgttgca

SEQ ID NO: 7562 - DNA, 17 bp, Artificial sequence
  Synthesized sequence
ctggcacgccatctcgg

SEQ ID NO: 7563 - DNA, 17 bp, Artificial sequence
  Synthesized sequence
gtggtcggccacctgcg

SEQ ID NO: 7564 - DNA, 17 bp, Artificial sequence
  Synthesized sequence
tcggccttgctggtgca

SEQ ID NO: 7565 - DNA, 17 bp, Artificial sequence
  Synthesized sequence
caggcccggcgcgcgct

SEQ ID NO: 7566 - DNA, 17 bp, Artificial sequence
  Synthesized sequence
gtggcagcttcctcgat

SEQ ID NO: 7567 - DNA, 17 bp, Artificial sequence
  Synthesized sequence
atggcaagctccttttc

SEQ ID NO: 7568 - DNA, 17 bp, Artificial sequence
  Synthesized sequence
ctggccattatcgtgcc

SEQ ID NO: 7569 - DNA, 17 bp, Artificial sequence
  Synthesized sequence
ctggcgaacctccagca

SEQ ID NO: 7570 - DNA, 17 bp, Artificial sequence
  Synthesized sequence
gcggaaggcaagctgca

SEQ ID NO: 7571 - DNA, 17 bp, Artificial sequence
  Synthesized sequence
ctggaacatcagtacca

SEQ ID NO: 7572 - DNA, 17 bp, Artificial sequence
  Synthesized sequence
cgggtagggcagtggca

SEQ ID NO: 7573 - DNA, 17 bp, Artificial sequence
  Synthesized sequence
tggggatgtttcttggt

SEQ ID NO: 7574 - DNA, 17 bp, Artificial sequence
  Synthesized sequence
ttggcgcacatggtgtg

SEQ ID NO: 7575 - DNA, 17 bp, Artificial sequence
  Synthesized sequence
ctggccaagacccagct

SEQ ID NO: 7576 - DNA, 17 bp, Artificial sequence
  Synthesized sequence
ctggcgctggatgtact

SEQ ID NO: 7577 - DNA, 17 bp, Artificial sequence
  Synthesized sequence
ctggacacgcacctgct

SEQ ID NO: 7578 - DNA, 17 bp, Artificial sequence
  Synthesized sequence
cgggcgcgtgctctgcg

SEQ ID NO: 7579 - DNA, 17 bp, Artificial sequence
  Synthesized sequence
ctggcccggcatttcgc

SEQ ID NO: 7580 - DNA, 17 bp, Artificial sequence
  Synthesized sequence
gtggaatgcgcggtact

SEQ ID NO: 7581 - DNA, 17 bp, Artificial sequence
  Synthesized sequence
gtggaatgcgcggtact

SEQ ID NO: 7582 - DNA, 17 bp, Artificial sequence
  Synthesized sequence
ctgtcgccgcactggca

SEQ ID NO: 7583 - DNA, 17 bp, Artificial sequence
  Synthesized sequence
ctgggtcgcgcgttgag

SEQ ID NO: 7584 - DNA, 17 bp, Artificial sequence
  Synthesized sequence
ctgccagaccagatgcg

SEQ ID NO: 7585 - DNA, 17 bp, Artificial sequence
  Synthesized sequence
aaggcccggcagacgct

SEQ ID NO: 7586 - DNA, 17 bp, Artificial sequence
  Synthesized sequence
caggcattgtcggtgcc

SEQ ID NO: 7587 - DNA, 17 bp, Artificial sequence
  Synthesized sequence
cgggccagccgctcgct

SEQ ID NO: 7588 - DNA, 17 bp, Artificial sequence
  Synthesized sequence
ctggcgttgctccagca

SEQ ID NO: 7589 - DNA, 17 bp, Artificial sequence
  Synthesized sequence
caggtagggctgctgcg

SEQ ID NO: 7590 - DNA, 17 bp, Artificial sequence
  Synthesized sequence
gaggcgcgggcatggcg

SEQ ID NO: 7591 - DNA, 17 bp, Artificial sequence
  Synthesized sequence
actgcgccgcctttgca

SEQ ID NO: 7592 - DNA, 17 bp, Artificial sequence
  Synthesized sequence
gtggttcctggtctgca

SEQ ID NO: 7593 - DNA, 17 bp, Artificial sequence
  Synthesized sequence
gtgacgcggtacttgac

SEQ ID NO: 7594 - DNA, 17 bp, Artificial sequence
  Synthesized sequence
ccggagcgccatctgct

SEQ ID NO: 7595 - DNA, 17 bp, Artificial sequence
  Synthesized sequence
ttgctcctggcgttgct

SEQ ID NO: 7596 - DNA, 17 bp, Artificial sequence
  Synthesized sequence
ctggcgttgctccagca

SEQ ID NO: 7597 - DNA, 17 bp, Artificial sequence
  Synthesized sequence
atggctgcgaactggcc

SEQ ID NO: 7598 - DNA, 17 bp, Artificial sequence
  Synthesized sequence
ctggcgcgctggctggc

SEQ ID NO: 7599 - DNA, 17 bp, Artificial sequence
  Synthesized sequence
acggcacgccgctggag

SEQ ID NO: 7600 - DNA, 17 bp, Artificial sequence
  Synthesized sequence
ctggcgccggagctgga

SEQ ID NO: 7601 - DNA, 17 bp, Artificial sequence
  Synthesized sequence
tcggtgcggctgttcct

SEQ ID NO: 7602 - DNA, 17 bp, Artificial sequence
  Synthesized sequence
atgcaaggcatcctgca

SEQ ID NO: 7603 - DNA, 17 bp, Artificial sequence
  Synthesized sequence
atgcaaggcatcctgca

SEQ ID NO: 7604 - DNA, 17 bp, Artificial sequence
  Synthesized sequence
ttggcggaactggcgct

SEQ ID NO: 7605 - DNA, 17 bp, Artificial sequence
  Synthesized sequence
ctggccggcagcgggca

SEQ ID NO: 7606 - DNA, 17 bp, Artificial sequence
  Synthesized sequence
ctgctgctggcgttgct

SEQ ID NO: 7607 - DNA, 17 bp, Artificial sequence
  Synthesized sequence
ctggccctttacccgca

SEQ ID NO: 7608 - DNA, 17 bp, Artificial sequence
  Synthesized sequence
ctggcactaccgccggt

SEQ ID NO: 7609 - DNA, 17 bp, Artificial sequence
  Synthesized sequence
ctggcgcacgtcctggc

SEQ ID NO: 7610 - DNA, 17 bp, Artificial sequence
  Synthesized sequence
ccggcggacggcttgcc

SEQ ID NO: 7611 - DNA, 17 bp, Artificial sequence
  Synthesized sequence
ctcgccctggcctggct

SEQ ID NO: 7612 - DNA, 17 bp, Artificial sequence
  Synthesized sequence
gtggtcgatcgcctgct

SEQ ID NO: 7613 - DNA, 17 bp, Artificial sequence
  Synthesized sequence
gtggtcgatcgcctgct

SEQ ID NO: 7614 - DNA, 17 bp, Artificial sequence
  Synthesized sequence
tcggcatcgagctggcc

SEQ ID NO: 7615 - DNA, 17 bp, Artificial sequence
  Synthesized sequence
atggcaggattcctttt

SEQ ID NO: 7616 - DNA, 17 bp, Artificial sequence
  Synthesized sequence
ctggaaggggtttccct

SEQ ID NO: 7617 - DNA, 17 bp, Artificial sequence
  Synthesized sequence
atgccgcgcccctggcc

SEQ ID NO: 7618 - DNA, 17 bp, Artificial sequence
  Synthesized sequence
cgggcagggcgtgcgca

SEQ ID NO: 7619 - DNA, 17 bp, Artificial sequence
  Synthesized sequence
ctggcctggcccttaga

SEQ ID NO: 7620 - DNA, 17 bp, Artificial sequence
  Synthesized sequence
ctggcgctggaggtcct

SEQ ID NO: 7621 - DNA, 17 bp, Artificial sequence
  Synthesized sequence
ccggcaggacccgtcct

SEQ ID NO: 7622 - DNA, 17 bp, Artificial sequence
  Synthesized sequence
ttggtggagcgctggct

SEQ ID NO: 7623 - DNA, 17 bp, Artificial sequence
  Synthesized sequence
ctggccagtcatccgct

SEQ ID NO: 7624 - DNA, 17 bp, Artificial sequence
  Synthesized sequence
tcggcctggccgctgcg

SEQ ID NO: 7625 - DNA, 17 bp, Artificial sequence
  Synthesized sequence
atcgcccgcggattgga

SEQ ID NO: 7626 - DNA, 17 bp, Artificial sequence
  Synthesized sequence
cagggagaagcgttgcc

SEQ ID NO: 7627 - DNA, 17 bp, Artificial sequence
  Synthesized sequence
tcagcaaccgacttgca

SEQ ID NO: 7628 - DNA, 17 bp, Artificial sequence
  Synthesized sequence
atggcacggcggctatg

SEQ ID NO: 7629 - DNA, 17 bp, Artificial sequence
  Synthesized sequence
ctggcattatatgcgcc

SEQ ID NO: 7630 - DNA, 17 bp, Artificial sequence
  Synthesized sequence
ctggcgccctgaaggct

SEQ ID NO: 7631 - DNA, 17 bp, Artificial sequence
  Synthesized sequence
gtggaattgctgcggca

SEQ ID NO: 7632 - DNA, 17 bp, Artificial sequence
  Synthesized sequence
ctggccagcttcgtcca

SEQ ID NO: 7633 - DNA, 17 bp, Artificial sequence
  Synthesized sequence
gtggaaagcctgatcca

SEQ ID NO: 7634 - DNA, 17 bp, Artificial sequence
  Synthesized sequence
ctggaacccgcgcagca

SEQ ID NO: 7635 - DNA, 17 bp, Artificial sequence
  Synthesized sequence
ctggaaggaccagttct

SEQ ID NO: 7636 - DNA, 17 bp, Artificial sequence
  Synthesized sequence
cgggcctgcgattggct

SEQ ID NO: 7637 - DNA, 17 bp, Artificial sequence
  Synthesized sequence
acggcgcttcgggtgct

SEQ ID NO: 7638 - DNA, 17 bp, Artificial sequence
  Synthesized sequence
ctggcagtcttcgggcg

SEQ ID NO: 7639 - DNA, 17 bp, Artificial sequence
  Synthesized sequence
ctggtcgtggggttgcg

SEQ ID NO: 7640 - DNA, 17 bp, Artificial sequence
  Synthesized sequence
agggcgtcggcgttgcg

SEQ ID NO: 7641 - DNA, 17 bp, Artificial sequence
  Synthesized sequence
ttggcgccctcctggat

SEQ ID NO: 7642 - DNA, 17 bp, Artificial sequence
  Synthesized sequence
gcggctccgccgtggca

SEQ ID NO: 7643 - DNA, 17 bp, Artificial sequence
  Synthesized sequence
gtggcccactaccggcc

SEQ ID NO: 7644 - DNA, 17 bp, Artificial sequence
  Synthesized sequence
gttgccggtggcttgcc

SEQ ID NO: 7645 - DNA, 17 bp, Artificial sequence
  Synthesized sequence
gtggcttgccagtcgat

SEQ ID NO: 7646 - DNA, 17 bp, Artificial sequence
  Synthesized sequence
tcggcccgtccttcgcc

SEQ ID NO: 7647 - DNA, 17 bp, Artificial sequence
  Synthesized sequence
ttttcctgggttttgct

SEQ ID NO: 7648 - DNA, 17 bp, Artificial sequence
  Synthesized sequence
ctggcctgacgctccca

SEQ ID NO: 7649 - DNA, 17 bp, Artificial sequence
  Synthesized sequence
ctggcctgacgctccca

SEQ ID NO: 7650 - DNA, 17 bp, Artificial sequence
  Synthesized sequence
caggcgcggttcgggca

SEQ ID NO: 7651 - DNA, 17 bp, Artificial sequence
  Synthesized sequence
atggcggcagtctggcg

SEQ ID NO: 7652 - DNA, 17 bp, Artificial sequence
  Synthesized sequence
aaggcccgatgatggcg

SEQ ID NO: 7653 - DNA, 17 bp, Artificial sequence
  Synthesized sequence
tgggcccgctgctggcg

SEQ ID NO: 7654 - DNA, 17 bp, Artificial sequence
  Synthesized sequence
ttggcaatgcgcatccg

SEQ ID NO: 7655 - DNA, 17 bp, Artificial sequence
  Synthesized sequence
ctgctgctggcgttgct

SEQ ID NO: 7656 - DNA, 17 bp, Artificial sequence
  Synthesized sequence
ctgtcgttgcgtttgcg

SEQ ID NO: 7657 - DNA, 17 bp, Artificial sequence
  Synthesized sequence
ggggcaccggatctact

SEQ ID NO: 7658 - DNA, 17 bp, Artificial sequence
  Synthesized sequence
ctggagcccggttcgct

SEQ ID NO: 7659 - DNA, 17 bp, Artificial sequence
  Synthesized sequence
gtggcgaagatgctggt

SEQ ID NO: 7660 - DNA, 17 bp, Artificial sequence
  Synthesized sequence
acggcacgccctgtccc

SEQ ID NO: 7661 - DNA, 17 bp, Artificial sequence
  Synthesized sequence
atggcgcttcaggagct

SEQ ID NO: 7662 - DNA, 17 bp, Artificial sequence
  Synthesized sequence
tcggcacgctgtccgcc

SEQ ID NO: 7663 - DNA, 17 bp, Artificial sequence
  Synthesized sequence
agggctcgacctttccc

SEQ ID NO: 7664 - DNA, 17 bp, Artificial sequence
  Synthesized sequence
acggcgcgcgcctggcg

SEQ ID NO: 7665 - DNA, 17 bp, Artificial sequence
  Synthesized sequence
gcggcgcggcccgcgct

SEQ ID NO: 7666 - DNA, 17 bp, Artificial sequence
  Synthesized sequence
cgagcacgagttctgcc

SEQ ID NO: 7667 - DNA, 17 bp, Artificial sequence
  Synthesized sequence
gttgcacgacaccttcg

SEQ ID NO: 7668 - DNA, 17 bp, Artificial sequence
  Synthesized sequence
gtggcttcctcgatgcc

SEQ ID NO: 7669 - DNA, 17 bp, Artificial sequence
  Synthesized sequence
ccggcgctggcatggct

SEQ ID NO: 7670 - DNA, 17 bp, Artificial sequence
  Synthesized sequence
atggccctctcgctgta

SEQ ID NO: 7671 - DNA, 17 bp, Artificial sequence
  Synthesized sequence
atggccctctcgctgta

SEQ ID NO: 7672 - DNA, 17 bp, Artificial sequence
  Synthesized sequence
gcggccctggtgttgga

SEQ ID NO: 7673 - DNA, 17 bp, Artificial sequence
  Synthesized sequence
gtggcgcactccccgcc

SEQ ID NO: 7674 - DNA, 17 bp, Artificial sequence
  Synthesized sequence
ttggcataacggtgccc

SEQ ID NO: 7675 - DNA, 17 bp, Artificial sequence
  Synthesized sequence
taggcgcggtcgttgtc

SEQ ID NO: 7676 - DNA, 17 bp, Artificial sequence
  Synthesized sequence
ccggcgctggtcctgcg

SEQ ID NO: 7677 - DNA, 17 bp, Artificial sequence
  Synthesized sequence
acggcatcgtcttcgcc

SEQ ID NO: 7678 - DNA, 17 bp, Artificial sequence
  Synthesized sequence
ctggagcggcatcggca

SEQ ID NO: 7679 - DNA, 17 bp, Artificial sequence
  Synthesized sequence
gtggcagtggacccgcg

SEQ ID NO: 7680 - DNA, 17 bp, Artificial sequence
  Synthesized sequence
ttggcgcgttcgccgcc

SEQ ID NO: 7681 - DNA, 17 bp, Artificial sequence
  Synthesized sequence
ttggcgccgatcaggcc

SEQ ID NO: 7682 - DNA, 17 bp, Artificial sequence
  Synthesized sequence
caggatcgccccatgct

SEQ ID NO: 7683 - DNA, 17 bp, Artificial sequence
  Synthesized sequence
ttggcttgccgctggtt

SEQ ID NO: 7684 - DNA, 17 bp, Artificial sequence
  Synthesized sequence
gggggtcggctatggct

SEQ ID NO: 7685 - DNA, 17 bp, Artificial sequence
  Synthesized sequence
ctggaatacgcccggct

SEQ ID NO: 7686 - DNA, 17 bp, Artificial sequence
  Synthesized sequence
ctggcgcagagcgggcc

SEQ ID NO: 7687 - DNA, 17 bp, Artificial sequence
  Synthesized sequence
agcgcgcggcaattgcc

SEQ ID NO: 7688 - DNA, 17 bp, Artificial sequence
  Synthesized sequence
ctggcgcaaccagcgcg

SEQ ID NO: 7689 - DNA, 17 bp, Artificial sequence
  Synthesized sequence
atggcccgcccctaccc

SEQ ID NO: 7690 - DNA, 17 bp, Artificial sequence
  Synthesized sequence
ccggctcgctgctggcg

SEQ ID NO: 7691 - DNA, 17 bp, Artificial sequence
  Synthesized sequence
aaggcacgccgctggtg

SEQ ID NO: 7692 - DNA, 17 bp, Artificial sequence
  Synthesized sequence
gtggcgctctgggggct

SEQ ID NO: 7693 - DNA, 17 bp, Artificial sequence
  Synthesized sequence
tcggtgaggttcttgcg

SEQ ID NO: 7694 - DNA, 17 bp, Artificial sequence
  Synthesized sequence
cagggccagcacctgct

SEQ ID NO: 7695 - DNA, 17 bp, Artificial sequence
  Synthesized sequence
ttggtatcggcatttcg

SEQ ID NO: 7696 - DNA, 17 bp, Artificial sequence
  Synthesized sequence
ttggagccgagcctgcc

SEQ ID NO: 7697 - DNA, 17 bp, Artificial sequence
  Synthesized sequence
ctggcgcggcgatcacc

SEQ ID NO: 7698 - DNA, 17 bp, Artificial sequence
  Synthesized sequence
ctggcatggcggaatct

SEQ ID NO: 7699 - DNA, 17 bp, Artificial sequence
  Synthesized sequence
gtcgccgggccgatgct

SEQ ID NO: 7700 - DNA, 17 bp, Artificial sequence
  Synthesized sequence
gaggaaaacctgctgca

SEQ ID NO: 7701 - DNA, 17 bp, Artificial sequence
  Synthesized sequence
ttgccgcacctgctgcg

SEQ ID NO: 7702 - DNA, 17 bp, Artificial sequence
  Synthesized sequence
gcggtcgagcaattgca

SEQ ID NO: 7703 - DNA, 17 bp, Artificial sequence
  Synthesized sequence
ctggaaaccgccgtgcg

SEQ ID NO: 7704 - DNA, 17 bp, Artificial sequence
  Synthesized sequence
ctcgccagcctggtgca

SEQ ID NO: 7705 - DNA, 17 bp, Artificial sequence
  Synthesized sequence
agggcagcgccgctgcg

SEQ ID NO: 7706 - DNA, 17 bp, Artificial sequence
  Synthesized sequence
tgggaacaagccctgcc

SEQ ID NO: 7707 - DNA, 17 bp, Artificial sequence
  Synthesized sequence
ccggcgccgcccctgcc

SEQ ID NO: 7708 - DNA, 17 bp, Artificial sequence
  Synthesized sequence
ccggcgcgccctttccg

SEQ ID NO: 7709 - DNA, 17 bp, Artificial sequence
  Synthesized sequence
caggcaggcggatggcg

SEQ ID NO: 7710 - DNA, 17 bp, Artificial sequence
  Synthesized sequence
gtcgaacgacacttccg

SEQ ID NO: 7711 - DNA, 17 bp, Artificial sequence
  Synthesized sequence
gcggcgctcgggctgct

SEQ ID NO: 7712 - DNA, 17 bp, Artificial sequence
  Synthesized sequence
caggagcagggcttgcg

SEQ ID NO: 7713 - DNA, 17 bp, Artificial sequence
  Synthesized sequence
ctgggagcgtggctgcg

SEQ ID NO: 7714 - DNA, 17 bp, Artificial sequence
  Synthesized sequence
ttgccggccgggttgct

SEQ ID NO: 7715 - DNA, 17 bp, Artificial sequence
  Synthesized sequence
ctggaccgacctcggct

SEQ ID NO: 7716 - DNA, 17 bp, Artificial sequence
  Synthesized sequence
tcggcgcgacgattgtc

SEQ ID NO: 7717 - DNA, 17 bp, Artificial sequence
  Synthesized sequence
ccggcagcgctcttccg

SEQ ID NO: 7718 - DNA, 17 bp, Artificial sequence
  Synthesized sequence
acggcagcgccctggcg

SEQ ID NO: 7719 - DNA, 17 bp, Artificial sequence
  Synthesized sequence
atcggacggcaattccg

SEQ ID NO: 7720 - DNA, 17 bp, Artificial sequence
  Synthesized sequence
ccgggacacctgtggcg

SEQ ID NO: 7721 - DNA, 17 bp, Artificial sequence
  Synthesized sequence
ctggagggcagggtgca

SEQ ID NO: 7722 - DNA, 17 bp, Artificial sequence
  Synthesized sequence
ccgaaacaaacattgca

SEQ ID NO: 7723 - DNA, 17 bp, Artificial sequence
  Synthesized sequence
ggtggacgattattgcc

SEQ ID NO: 7724 - DNA, 17 bp, Artificial sequence
  Synthesized sequence
cgggcagggcgcgcgca

SEQ ID NO: 7725 - DNA, 17 bp, Artificial sequence
  Synthesized sequence
ctggtcctggccctgcc

SEQ ID NO: 7726 - DNA, 17 bp, Artificial sequence
  Synthesized sequence
atggcccgcgcgctggc

SEQ ID NO: 7727 - DNA, 17 bp, Artificial sequence
  Synthesized sequence
agggcgcatggctggct

SEQ ID NO: 7728 - DNA, 17 bp, Artificial sequence
  Synthesized sequence
ccggcaggctggtttcg

SEQ ID NO: 7729 - DNA, 17 bp, Artificial sequence
  Synthesized sequence
tgggccttccggttgcc

SEQ ID NO: 7730 - DNA, 17 bp, Artificial sequence
  Synthesized sequence
ttggcgcgaaagtggtg

SEQ ID NO: 7731 - DNA, 17 bp, Artificial sequence
  Synthesized sequence
ttgatcagggatttgct

SEQ ID NO: 7732 - DNA, 17 bp, Artificial sequence
  Synthesized sequence
atggaactcgccatgga

SEQ ID NO: 7733 - DNA, 17 bp, Artificial sequence
  Synthesized sequence
atggccaagcgcctggt

SEQ ID NO: 7734 - DNA, 17 bp, Artificial sequence
  Synthesized sequence
ctggcacggcaaggtcc

SEQ ID NO: 7735 - DNA, 17 bp, Artificial sequence
  Synthesized sequence
ctggccctggcctgcct

SEQ ID NO: 7736 - DNA, 17 bp, Artificial sequence
  Synthesized sequence
gaggcgcggctactggt

SEQ ID NO: 7737 - DNA, 17 bp, Artificial sequence
  Synthesized sequence
cgagcacagccatggca

SEQ ID NO: 7738 - DNA, 17 bp, Artificial sequence
  Synthesized sequence
ctggagaaggccatgct

SEQ ID NO: 7739 - DNA, 17 bp, Artificial sequence
  Synthesized sequence
ctgacgcccaagctgct

SEQ ID NO: 7740 - DNA, 17 bp, Artificial sequence
  Synthesized sequence
ccggcgcgctgttcgcc

SEQ ID NO: 7741 - DNA, 17 bp, Artificial sequence
  Synthesized sequence
tcggccaggcggtggct

SEQ ID NO: 7742 - DNA, 17 bp, Artificial sequence
  Synthesized sequence
caggccgagcagatgct

SEQ ID NO: 7743 - DNA, 17 bp, Artificial sequence
  Synthesized sequence
ccggcatcaaggatgcg

SEQ ID NO: 7744 - DNA, 17 bp, Artificial sequence
  Synthesized sequence
ctggcttgcggactgat

SEQ ID NO: 7745 - DNA, 17 bp, Artificial sequence
  Synthesized sequence
cgggctgtgccgttgcg

SEQ ID NO: 7746 - DNA, 17 bp, Artificial sequence
  Synthesized sequence
ccggcgcgccgttttcg

SEQ ID NO: 7747 - DNA, 17 bp, Artificial sequence
  Synthesized sequence
acggtacgtacttcgcg

SEQ ID NO: 7748 - DNA, 17 bp, Artificial sequence
  Synthesized sequence
atcgccggcctggtgca

SEQ ID NO: 7749 - DNA, 17 bp, Artificial sequence
  Synthesized sequence
atgccgcggacttcgcc

SEQ ID NO: 7750 - DNA, 17 bp, Artificial sequence
  Synthesized sequence
gtcgagcggctgctgct

SEQ ID NO: 7751 - DNA, 17 bp, Artificial sequence
  Synthesized sequence
ccggcagggcccgtgaa

SEQ ID NO: 7752 - DNA, 17 bp, Artificial sequence
  Synthesized sequence
caggccgaccacgtgct

SEQ ID NO: 7753 - DNA, 17 bp, Artificial sequence
  Synthesized sequence
aaggcactgccgctgga

SEQ ID NO: 7754 - DNA, 17 bp, Artificial sequence
  Synthesized sequence
ctagaacggaccttccg

SEQ ID NO: 7755 - DNA, 17 bp, Artificial sequence
  Synthesized sequence
cgggccccggccttcct

SEQ ID NO: 7756 - DNA, 17 bp, Artificial sequence
  Synthesized sequence
ctggagccgcgcctgcc

SEQ ID NO: 7757 - DNA, 17 bp, Artificial sequence
  Synthesized sequence
ctggccagctacctggt

SEQ ID NO: 7758 - DNA, 17 bp, Artificial sequence
  Synthesized sequence
ttgccgccgcccttgtt

SEQ ID NO: 7759 - DNA, 17 bp, Artificial sequence
  Synthesized sequence
ctggtcgccttcctgct

SEQ ID NO: 7760 - DNA, 17 bp, Artificial sequence
  Synthesized sequence
atcgccggcaccctgct

SEQ ID NO: 7761 - DNA, 17 bp, Artificial sequence
  Synthesized sequence
atggcgatgccctggcc

SEQ ID NO: 7762 - DNA, 17 bp, Artificial sequence
  Synthesized sequence
cggagatgattgttgca

SEQ ID NO: 7763 - DNA, 17 bp, Artificial sequence
  Synthesized sequence
gcggcctgttactagct

SEQ ID NO: 7764 - DNA, 17 bp, Artificial sequence
  Synthesized sequence
gttgaacatgaagtgct

SEQ ID NO: 7765 - DNA, 17 bp, Artificial sequence
  Synthesized sequence
atgtccctgagggtgca

SEQ ID NO: 7766 - DNA, 17 bp, Artificial sequence
  Synthesized sequence
ctggagcggcgcctgga

SEQ ID NO: 7767 - DNA, 17 bp, Artificial sequence
  Synthesized sequence
ccggcagcgcgctggcg

SEQ ID NO: 7768 - DNA, 17 bp, Artificial sequence
  Synthesized sequence
ccggctgatcagttgcc

SEQ ID NO: 7769 - DNA, 17 bp, Artificial sequence
  Synthesized sequence
caggcgggcgaactgct

SEQ ID NO: 7770 - DNA, 17 bp, Artificial sequence
  Synthesized sequence
attgatcgccaattgcc

SEQ ID NO: 7771 - DNA, 17 bp, Artificial sequence
  Synthesized sequence
ctggaaggaactgagct

SEQ ID NO: 7772 - DNA, 17 bp, Artificial sequence
  Synthesized sequence
ggggcgcgctgctggcc

SEQ ID NO: 7773 - DNA, 17 bp, Artificial sequence
  Synthesized sequence
ctggccgaccagttccc

SEQ ID NO: 7774 - DNA, 17 bp, Artificial sequence
  Synthesized sequence
atggaatgaatgtgcca

SEQ ID NO: 7775 - DNA, 17 bp, Artificial sequence
  Synthesized sequence
gtggcccagcgagcgcc

SEQ ID NO: 7776 - DNA, 17 bp, Artificial sequence
  Synthesized sequence
gcggtagacaacctgct

SEQ ID NO: 7777 - DNA, 17 bp, Artificial sequence
  Synthesized sequence
gcggcaaagggcttgac

SEQ ID NO: 7778 - DNA, 17 bp, Artificial sequence
  Synthesized sequence
atgccttggctgtttct

SEQ ID NO: 7779 - DNA, 17 bp, Artificial sequence
  Synthesized sequence
atgcccagcatgctgct

SEQ ID NO: 7780 - DNA, 17 bp, Artificial sequence
  Synthesized sequence
caggcagcggctttcca

SEQ ID NO: 7781 - DNA, 17 bp, Artificial sequence
  Synthesized sequence
ctggcctgcctgcagcg

SEQ ID NO: 7782 - DNA, 17 bp, Artificial sequence
  Synthesized sequence
gcggtactcggctggct

SEQ ID NO: 7783 - DNA, 17 bp, Artificial sequence
  Synthesized sequence
ctgtccccggcactgct

SEQ ID NO: 7784 - DNA, 17 bp, Artificial sequence
  Synthesized sequence
ctgccgctggaagtgct

SEQ ID NO: 7785 - DNA, 17 bp, Artificial sequence
  Synthesized sequence
ctggcggtcggcctgcg

SEQ ID NO: 7786 - DNA, 17 bp, Artificial sequence
  Synthesized sequence
ctgggccggtttcggca

SEQ ID NO: 7787 - DNA, 17 bp, Artificial sequence
  Synthesized sequence
cgggcgctggcgatgca

SEQ ID NO: 7788 - DNA, 17 bp, Artificial sequence
  Synthesized sequence
gttgcaggggagttgag

SEQ ID NO: 7789 - DNA, 17 bp, Artificial sequence
  Synthesized sequence
gaggaatggccgctgcg

SEQ ID NO: 7790 - DNA, 17 bp, Artificial sequence
  Synthesized sequence
cagccacatcgtctgca

SEQ ID NO: 7791 - DNA, 17 bp, Artificial sequence
  Synthesized sequence
gccgaactggtgttgca

SEQ ID NO: 7792 - DNA, 17 bp, Artificial sequence
  Synthesized sequence
gcggcccggcacgggct

SEQ ID NO: 7793 - DNA, 17 bp, Artificial sequence
  Synthesized sequence
ttcgcccgccgctggcg

SEQ ID NO: 7794 - DNA, 17 bp, Artificial sequence
  Synthesized sequence
acgccacctgaattgcg

SEQ ID NO: 7795 - DNA, 17 bp, Artificial sequence
  Synthesized sequence
gtggactacatcttcca

SEQ ID NO: 7796 - DNA, 17 bp, Artificial sequence
  Synthesized sequence
gtggccccgctgctggc

SEQ ID NO: 7797 - DNA, 17 bp, Artificial sequence
  Synthesized sequence
gcagcacggcgctggcg

SEQ ID NO: 7798 - DNA, 17 bp, Artificial sequence
  Synthesized sequence
ctggcgcgcggcatccg

SEQ ID NO: 7799 - DNA, 17 bp, Artificial sequence
  Synthesized sequence
ccggcagaggcttggcg

SEQ ID NO: 7800 - DNA, 17 bp, Artificial sequence
  Synthesized sequence
ctggccggcagcaagct

SEQ ID NO: 7801 - DNA, 17 bp, Artificial sequence
  Synthesized sequence
ccgccacatcatctgca

SEQ ID NO: 7802 - DNA, 17 bp, Artificial sequence
  Synthesized sequence
ctggccggccgtgggct

SEQ ID NO: 7803 - DNA, 17 bp, Artificial sequence
  Synthesized sequence
ctggtcttcccgctgct

SEQ ID NO: 7804 - DNA, 17 bp, Artificial sequence
  Synthesized sequence
ttcgcgacgctgttgcc

SEQ ID NO: 7805 - DNA, 17 bp, Artificial sequence
  Synthesized sequence
ccgccacggcgtctgcc

SEQ ID NO: 7806 - DNA, 17 bp, Artificial sequence
  Synthesized sequence
ctggcgctggcgatcct

SEQ ID NO: 7807 - DNA, 17 bp, Artificial sequence
  Synthesized sequence
ccggtccagcttgtgct

SEQ ID NO: 7808 - DNA, 17 bp, Artificial sequence
  Synthesized sequence
ggggtatccggcttgcc

SEQ ID NO: 7809 - DNA, 17 bp, Artificial sequence
  Synthesized sequence
aaggccgggacgtcgct

SEQ ID NO: 7810 - DNA, 17 bp, Artificial sequence
  Synthesized sequence
ggggcgtggatgatgcg

SEQ ID NO: 7811 - DNA, 17 bp, Artificial sequence
  Synthesized sequence
tgggcatgaccctggaa

SEQ ID NO: 7812 - DNA, 17 bp, Artificial sequence
  Synthesized sequence
agggcatcgagctggcg

SEQ ID NO: 7813 - DNA, 17 bp, Artificial sequence
  Synthesized sequence
atgggaagccgactgat

SEQ ID NO: 7814 - DNA, 17 bp, Artificial sequence
  Synthesized sequence
ctggccggaacaacgct

SEQ ID NO: 7815 - DNA, 17 bp, Artificial sequence
  Synthesized sequence
tgggcggaggtcctgca

SEQ ID NO: 7816 - DNA, 17 bp, Artificial sequence
  Synthesized sequence
atgacaccgatttcgat

SEQ ID NO: 7817 - DNA, 17 bp, Artificial sequence
  Synthesized sequence
tgggcggaggtcctgca

SEQ ID NO: 7818 - DNA, 17 bp, Artificial sequence
  Synthesized sequence
ttcgagcggctgctgct

SEQ ID NO: 7819 - DNA, 17 bp, Artificial sequence
  Synthesized sequence
gtggcccggcgtttcgc

SEQ ID NO: 7820 - DNA, 17 bp, Artificial sequence
  Synthesized sequence
gtggcccggcgtttcgc

SEQ ID NO: 7821 - DNA, 17 bp, Artificial sequence
  Synthesized sequence
ccggcatcgtcctggcc

SEQ ID NO: 7822 - DNA, 17 bp, Artificial sequence
  Synthesized sequence
cgcgcccggcgtttgcc

SEQ ID NO: 7823 - DNA, 17 bp, Artificial sequence
  Synthesized sequence
caggcgcgcctcgagct

SEQ ID NO: 7824 - DNA, 17 bp, Artificial sequence
  Synthesized sequence
gccgcgccaatgttgca

SEQ ID NO: 7825 - DNA, 17 bp, Artificial sequence
  Synthesized sequence
ctggcgttgctgccgct

SEQ ID NO: 7826 - DNA, 17 bp, Artificial sequence
  Synthesized sequence
ttggcctggccccggcg

SEQ ID NO: 7827 - DNA, 17 bp, Artificial sequence
  Synthesized sequence
aaggccaacctgctgct

SEQ ID NO: 7828 - DNA, 17 bp, Artificial sequence
  Synthesized sequence
ttgggatgcagactgtt

SEQ ID NO: 7829 - DNA, 17 bp, Artificial sequence
  Synthesized sequence
ttgcccagggtgctgca

SEQ ID NO: 7830 - DNA, 17 bp, Artificial sequence
  Synthesized sequence
gtggccggcacgctgat

SEQ ID NO: 7831 - DNA, 17 bp, Artificial sequence
  Synthesized sequence
gaggccgaactggtgct

SEQ ID NO: 7832 - DNA, 17 bp, Artificial sequence
  Synthesized sequence
ctggtacggcagttcgc

SEQ ID NO: 7833 - DNA, 17 bp, Artificial sequence
  Synthesized sequence
caggcctcgctggtgca

SEQ ID NO: 7834 - DNA, 17 bp, Artificial sequence
  Synthesized sequence
gtggctcaatagccgcg

SEQ ID NO: 7835 - DNA, 17 bp, Artificial sequence
  Synthesized sequence
ttgcgcctggccttgca

SEQ ID NO: 7836 - DNA, 17 bp, Artificial sequence
  Synthesized sequence
atcgtacgtctcttccg

SEQ ID NO: 7837 - DNA, 17 bp, Artificial sequence
  Synthesized sequence
gtggcctgcgacatcca

SEQ ID NO: 7838 - DNA, 17 bp, Artificial sequence
  Synthesized sequence
gcggcggagaccctgct

SEQ ID NO: 7839 - DNA, 17 bp, Artificial sequence
  Synthesized sequence
ctggaccgtcagttggc

SEQ ID NO: 7840 - DNA, 17 bp, Artificial sequence
  Synthesized sequence
ctggcactcctggctca

SEQ ID NO: 7841 - DNA, 17 bp, Artificial sequence
  Synthesized sequence
gcggcgcgggtcacgct

SEQ ID NO: 7842 - DNA, 17 bp, Artificial sequence
  Synthesized sequence
cgggcccgagcatcgcc

SEQ ID NO: 7843 - DNA, 17 bp, Artificial sequence
  Synthesized sequence
gtggtgaagacgctgct

SEQ ID NO: 7844 - DNA, 17 bp, Artificial sequence
  Synthesized sequence
atcgagcggctgctgct

SEQ ID NO: 7845 - DNA, 17 bp, Artificial sequence
  Synthesized sequence
atcgagcggctgctgct

SEQ ID NO: 7846 - DNA, 17 bp, Artificial sequence
  Synthesized sequence
atagccaaggcgttgcg

SEQ ID NO: 7847 - DNA, 17 bp, Artificial sequence
  Synthesized sequence
ccggcgtgcccgtggca

SEQ ID NO: 7848 - DNA, 17 bp, Artificial sequence
  Synthesized sequence
atgtcccgggcgatgcg

SEQ ID NO: 7849 - DNA, 17 bp, Artificial sequence
  Synthesized sequence
ctggcagaccctgttcc

SEQ ID NO: 7850 - DNA, 17 bp, Artificial sequence
  Synthesized sequence
ctggcggccctttttcg

SEQ ID NO: 7851 - DNA, 17 bp, Artificial sequence
  Synthesized sequence
tacgcacggacggtgcg

SEQ ID NO: 7852 - DNA, 17 bp, Artificial sequence
  Synthesized sequence
atggtcggtggcctgct

SEQ ID NO: 7853 - DNA, 17 bp, Artificial sequence
  Synthesized sequence
caggcctgcctgctgcg

SEQ ID NO: 7854 - DNA, 17 bp, Artificial sequence
  Synthesized sequence
tcggcgcgctgctggcg

SEQ ID NO: 7855 - DNA, 17 bp, Artificial sequence
  Synthesized sequence
ttgcctgggcccctgca

SEQ ID NO: 7856 - DNA, 17 bp, Artificial sequence
  Synthesized sequence
ctggcgcaacctcagcg

SEQ ID NO: 7857 - DNA, 17 bp, Artificial sequence
  Synthesized sequence
gtgcgcctccagttgct

SEQ ID NO: 7858 - DNA, 17 bp, Artificial sequence
  Synthesized sequence
ggggctggcctatcgca

SEQ ID NO: 7859 - DNA, 17 bp, Artificial sequence
  Synthesized sequence
caggcctgggtgatgcg

SEQ ID NO: 7860 - DNA, 17 bp, Artificial sequence
  Synthesized sequence
tagggacatcacatgcg

SEQ ID NO: 7861 - DNA, 17 bp, Artificial sequence
  Synthesized sequence
ctgtcctacctggtgct

SEQ ID NO: 7862 - DNA, 17 bp, Artificial sequence
  Synthesized sequence
caggagcgcaccgtgct

SEQ ID NO: 7863 - DNA, 17 bp, Artificial sequence
  Synthesized sequence
ccggcaccgtactcgga

SEQ ID NO: 7864 - DNA, 17 bp, Artificial sequence
  Synthesized sequence
ctggaacgcggcgtggc

SEQ ID NO: 7865 - DNA, 17 bp, Artificial sequence
  Synthesized sequence
gtagcgcaggcgttgat

SEQ ID NO: 7866 - DNA, 17 bp, Artificial sequence
  Synthesized sequence
ctgtcgccattgtcgct

SEQ ID NO: 7867 - DNA, 17 bp, Artificial sequence
  Synthesized sequence
ctgggaacgttgtcgcc

SEQ ID NO: 7868 - DNA, 17 bp, Artificial sequence
  Synthesized sequence
ttgcccttgccattgcc

SEQ ID NO: 7869 - DNA, 17 bp, Artificial sequence
  Synthesized sequence
actgcacgggccgtgcc

SEQ ID NO: 7870 - DNA, 17 bp, Artificial sequence
  Synthesized sequence
cttgcaggtgtatggcg

SEQ ID NO: 7871 - DNA, 17 bp, Artificial sequence
  Synthesized sequence
ctgcgattacagttgcg

SEQ ID NO: 7872 - DNA, 17 bp, Artificial sequence
  Synthesized sequence
ttggaaggaggtgcgct

SEQ ID NO: 7873 - DNA, 17 bp, Artificial sequence
  Synthesized sequence
ctggcgctgatcccgcc

SEQ ID NO: 7874 - DNA, 17 bp, Artificial sequence
  Synthesized sequence
ctggaacagcaacttcg

SEQ ID NO: 7875 - DNA, 17 bp, Artificial sequence
  Synthesized sequence
taggcgtacttcttgat

SEQ ID NO: 7876 - DNA, 17 bp, Artificial sequence
  Synthesized sequence
ccggcacgaactctacc

SEQ ID NO: 7877 - DNA, 17 bp, Artificial sequence
  Synthesized sequence
atggctacgagctggcg

SEQ ID NO: 7878 - DNA, 17 bp, Artificial sequence
  Synthesized sequence
aagggactggaatcgct

SEQ ID NO: 7879 - DNA, 17 bp, Artificial sequence
  Synthesized sequence
atggcgaccctcttccc

SEQ ID NO: 7880 - DNA, 17 bp, Artificial sequence
  Synthesized sequence
caggcccatggattgat

SEQ ID NO: 7881 - DNA, 17 bp, Artificial sequence
  Synthesized sequence
gtggctcgccggctggc

SEQ ID NO: 7882 - DNA, 17 bp, Artificial sequence
  Synthesized sequence
ctggctcccggccagca

SEQ ID NO: 7883 - DNA, 17 bp, Artificial sequence
  Synthesized sequence
ctggcctaccaggagct

SEQ ID NO: 7884 - DNA, 17 bp, Artificial sequence
  Synthesized sequence
atggcgcgcagtatacc

SEQ ID NO: 7885 - DNA, 17 bp, Artificial sequence
  Synthesized sequence
gcggcaaaggccttgac

SEQ ID NO: 7886 - DNA, 17 bp, Artificial sequence
  Synthesized sequence
ctggcagatggtattca

SEQ ID NO: 7887 - DNA, 17 bp, Artificial sequence
  Synthesized sequence
atggcgcgctgctggtg

SEQ ID NO: 7888 - DNA, 17 bp, Artificial sequence
  Synthesized sequence
ctgcaaggcctgatgct

SEQ ID NO: 7889 - DNA, 17 bp, Artificial sequence
  Synthesized sequence
ttgccgctcagcgtgct

SEQ ID NO: 7890 - DNA, 17 bp, Artificial sequence
  Synthesized sequence
atcgccggtatcctgct

SEQ ID NO: 7891 - DNA, 17 bp, Artificial sequence
  Synthesized sequence
ctgatgcggttgctgct

SEQ ID NO: 7892 - DNA, 17 bp, Artificial sequence
  Synthesized sequence
ccggccatgtccttgcg

SEQ ID NO: 7893 - DNA, 17 bp, Artificial sequence
  Synthesized sequence
ccggccatgtccttgcg

SEQ ID NO: 7894 - DNA, 17 bp, Artificial sequence
  Synthesized sequence
atggctggcatgctggt

SEQ ID NO: 7895 - DNA, 17 bp, Artificial sequence
  Synthesized sequence
ctggttcgacaagggct

SEQ ID NO: 7896 - DNA, 17 bp, Artificial sequence
  Synthesized sequence
cgagcacttcttctgct

SEQ ID NO: 7897 - DNA, 17 bp, Artificial sequence
  Synthesized sequence
atggcggcgtgcatgcc

SEQ ID NO: 7898 - DNA, 17 bp, Artificial sequence
  Synthesized sequence
cgggccgagttcctgca

SEQ ID NO: 7899 - DNA, 17 bp, Artificial sequence
  Synthesized sequence
gcgacacatacgctgct

SEQ ID NO: 7900 - DNA, 17 bp, Artificial sequence
  Synthesized sequence
gcgacacatacgctgct

SEQ ID NO: 7901 - DNA, 17 bp, Artificial sequence
  Synthesized sequence
ctgggaaatcgtgtgcc

SEQ ID NO: 7902 - DNA, 17 bp, Artificial sequence
  Synthesized sequence
ctgtcgcggcttttccc

SEQ ID NO: 7903 - DNA, 17 bp, Artificial sequence
  Synthesized sequence
ttggccaggcgggtgaa

SEQ ID NO: 7904 - DNA, 17 bp, Artificial sequence
  Synthesized sequence
ctggggcgcattcggct

SEQ ID NO: 7905 - DNA, 17 bp, Artificial sequence
  Synthesized sequence
ctggccggcgccctggt

SEQ ID NO: 7906 - DNA, 17 bp, Artificial sequence
  Synthesized sequence
gaggaacggcaccggca

SEQ ID NO: 7907 - DNA, 17 bp, Artificial sequence
  Synthesized sequence
gtggtggacaagctgct

SEQ ID NO: 7908 - DNA, 17 bp, Artificial sequence
  Synthesized sequence
gctgcacgacctctgcc

SEQ ID NO: 7909 - DNA, 17 bp, Artificial sequence
  Synthesized sequence
ctggcacgcctgctcgc

SEQ ID NO: 7910 - DNA, 17 bp, Artificial sequence
  Synthesized sequence
atggcgcaactttcccg

SEQ ID NO: 7911 - DNA, 17 bp, Artificial sequence
  Synthesized sequence
ctggcgactgagtttct

SEQ ID NO: 7912 - DNA, 17 bp, Artificial sequence
  Synthesized sequence
gtcggacgacaatcgcc

SEQ ID NO: 7913 - DNA, 17 bp, Artificial sequence
  Synthesized sequence
atagaaaaagccttgcc

SEQ ID NO: 7914 - DNA, 17 bp, Artificial sequence
  Synthesized sequence
atggctcgtgttaagcg

SEQ ID NO: 7915 - DNA, 17 bp, Artificial sequence
  Synthesized sequence
ctggcaggccttgcggt

SEQ ID NO: 7916 - DNA, 17 bp, Artificial sequence
  Synthesized sequence
ctggcaggccttgcggt

SEQ ID NO: 7917 - DNA, 17 bp, Artificial sequence
  Synthesized sequence
ctggaagttcccctgcg

SEQ ID NO: 7918 - DNA, 17 bp, Artificial sequence
  Synthesized sequence
ctgcgacgacttttccg

SEQ ID NO: 7919 - DNA, 17 bp, Artificial sequence
  Synthesized sequence
tcggcctgggcattgat

SEQ ID NO: 7920 - DNA, 17 bp, Artificial sequence
  Synthesized sequence
ctggccatggactggcc

SEQ ID NO: 7921 - DNA, 17 bp, Artificial sequence
  Synthesized sequence
ccggcacggccagttcc

SEQ ID NO: 7922 - DNA, 17 bp, Artificial sequence
  Synthesized sequence
tcgtggcggctcttgct

SEQ ID NO: 7923 - DNA, 17 bp, Artificial sequence
  Synthesized sequence
agggcacggcgctgccc

SEQ ID NO: 7924 - DNA, 17 bp, Artificial sequence
  Synthesized sequence
aaggcacgggcggcgcc

SEQ ID NO: 7925 - DNA, 17 bp, Artificial sequence
  Synthesized sequence
atcgcccgcccatcgcg

SEQ ID NO: 7926 - DNA, 17 bp, Artificial sequence
  Synthesized sequence
gtgtccaggccggtgct

SEQ ID NO: 7927 - DNA, 17 bp, Artificial sequence
  Synthesized sequence
gtgctagagtcattgcg

SEQ ID NO: 7928 - DNA, 17 bp, Artificial sequence
  Synthesized sequence
ctggcgcaacgcctgtc

SEQ ID NO: 7929 - DNA, 17 bp, Artificial sequence
  Synthesized sequence
ccgggattttttttgcc

SEQ ID NO: 7930 - DNA, 17 bp, Artificial sequence
  Synthesized sequence
agggcgcaggcgctgcg

SEQ ID NO: 7931 - DNA, 17 bp, Artificial sequence
  Synthesized sequence
gtgtgcggcatcttgca

SEQ ID NO: 7932 - DNA, 17 bp, Artificial sequence
  Synthesized sequence
ctggcgcccgcagcgct

SEQ ID NO: 7933 - DNA, 17 bp, Artificial sequence
  Synthesized sequence
gtcgaacccgccctgct

SEQ ID NO: 7934 - DNA, 17 bp, Artificial sequence
  Synthesized sequence
atcgccggcatgctgct

SEQ ID NO: 7935 - DNA, 17 bp, Artificial sequence
  Synthesized sequence
ctggaaccgctgctgac

SEQ ID NO: 7936 - DNA, 17 bp, Artificial sequence
  Synthesized sequence
ctgatatcgctcgtgca

SEQ ID NO: 7937 - DNA, 17 bp, Artificial sequence
  Synthesized sequence
agagcatggatttagct

SEQ ID NO: 7938 - DNA, 17 bp, Artificial sequence
  Synthesized sequence
gtggacagccagttgtt

SEQ ID NO: 7939 - DNA, 17 bp, Artificial sequence
  Synthesized sequence
ctcgcatcgattttgag

SEQ ID NO: 7940 - DNA, 17 bp, Artificial sequence
  Synthesized sequence
gtggtacgggtcgggtt

SEQ ID NO: 7941 - DNA, 17 bp, Artificial sequence
  Synthesized sequence
ctgcaaccctgcctgca

SEQ ID NO: 7942 - DNA, 17 bp, Artificial sequence
  Synthesized sequence
ctgcctccaccctcgct

SEQ ID NO: 7943 - DNA, 17 bp, Artificial sequence
  Synthesized sequence
ctggcgcaggtactggc

SEQ ID NO: 7944 - DNA, 17 bp, Artificial sequence
  Synthesized sequence
cgggtgcgcaccctgct

SEQ ID NO: 7945 - DNA, 17 bp, Artificial sequence
  Synthesized sequence
gaggtactgagcctgcg

SEQ ID NO: 7946 - DNA, 17 bp, Artificial sequence
  Synthesized sequence
gaggcctggtacctgcg

SEQ ID NO: 7947 - DNA, 17 bp, Artificial sequence
  Synthesized sequence
ataggactcgccctgct

SEQ ID NO: 7948 - DNA, 17 bp, Artificial sequence
  Synthesized sequence
ctggagaaaaccctgca

SEQ ID NO: 7949 - DNA, 17 bp, Artificial sequence
  Synthesized sequence
cttgaaggccacctgca

SEQ ID NO: 7950 - DNA, 17 bp, Artificial sequence
  Synthesized sequence
gtggcacctatgcagat

SEQ ID NO: 7951 - DNA, 17 bp, Artificial sequence
  Synthesized sequence
gttgcacgaagcccgcc

SEQ ID NO: 7952 - DNA, 17 bp, Artificial sequence
  Synthesized sequence
gtggcgcgcattttatg

SEQ ID NO: 7953 - DNA, 17 bp, Artificial sequence
  Synthesized sequence
gtggacggcgagctgca

SEQ ID NO: 7954 - DNA, 17 bp, Artificial sequence
  Synthesized sequence
cgggatctatcattgca

SEQ ID NO: 7955 - DNA, 17 bp, Artificial sequence
  Synthesized sequence
gccgcacgtatcatgcg

SEQ ID NO: 7956 - DNA, 17 bp, Artificial sequence
  Synthesized sequence
ctggatcgcggcttggc

SEQ ID NO: 7957 - DNA, 17 bp, Artificial sequence
  Synthesized sequence
ccggcgcgatgatcgcc

SEQ ID NO: 7958 - DNA, 17 bp, Artificial sequence
  Synthesized sequence
tcggaacagggcgtgcc

SEQ ID NO: 7959 - DNA, 17 bp, Artificial sequence
  Synthesized sequence
gtgggcaccagcttgcg

SEQ ID NO: 7960 - DNA, 17 bp, Artificial sequence
  Synthesized sequence
agggcacggggcgtggg

SEQ ID NO: 7961 - DNA, 17 bp, Artificial sequence
  Synthesized sequence
ctggcggggggcgggca

SEQ ID NO: 7962 - DNA, 17 bp, Artificial sequence
  Synthesized sequence
gtcgggccggctttgct

SEQ ID NO: 7963 - DNA, 17 bp, Artificial sequence
  Synthesized sequence
ccggcggtggacttgcc

SEQ ID NO: 7964 - DNA, 17 bp, Artificial sequence
  Synthesized sequence
tgggtagagttgctgca

SEQ ID NO: 7965 - DNA, 17 bp, Artificial sequence
  Synthesized sequence
ctggaaaatgtctggcc

SEQ ID NO: 7966 - DNA, 17 bp, Artificial sequence
  Synthesized sequence
ctggaaaatgtctggcc

SEQ ID NO: 7967 - DNA, 17 bp, Artificial sequence
  Synthesized sequence
ctggagaacgtgatgct

SEQ ID NO: 7968 - DNA, 17 bp, Artificial sequence
  Synthesized sequence
aaggcacgggcaatggc

SEQ ID NO: 7969 - DNA, 17 bp, Artificial sequence
  Synthesized sequence
ttggcaagttcctctcc

SEQ ID NO: 7970 - DNA, 17 bp, Artificial sequence
  Synthesized sequence
tcgtccgggattttgca

SEQ ID NO: 7971 - DNA, 17 bp, Artificial sequence
  Synthesized sequence
tggggctgcctcttgcc

SEQ ID NO: 7972 - DNA, 17 bp, Artificial sequence
  Synthesized sequence
ccggctcgctgctggcg

SEQ ID NO: 7973 - DNA, 17 bp, Artificial sequence
  Synthesized sequence
ctggtggactacgtgct

SEQ ID NO: 7974 - DNA, 17 bp, Artificial sequence
  Synthesized sequence
ctggatcgcttcctgat

SEQ ID NO: 7975 - DNA, 17 bp, Artificial sequence
  Synthesized sequence
gtcgactggctcttgcc

SEQ ID NO: 7976 - DNA, 17 bp, Artificial sequence
  Synthesized sequence
ttcggccgcatcctgct

SEQ ID NO: 7977 - DNA, 17 bp, Artificial sequence
  Synthesized sequence
gaggaaggcacggtgct

SEQ ID NO: 7978 - DNA, 17 bp, Artificial sequence
  Synthesized sequence
ccggcaaggcgaaggct

SEQ ID NO: 7979 - DNA, 17 bp, Artificial sequence
  Synthesized sequence
gtgggcggcggtctgca

SEQ ID NO: 7980 - DNA, 17 bp, Artificial sequence
  Synthesized sequence
gcggcctcgggattgcc

SEQ ID NO: 7981 - DNA, 17 bp, Artificial sequence
  Synthesized sequence
tttgcattgttcttgac

SEQ ID NO: 7982 - DNA, 17 bp, Artificial sequence
  Synthesized sequence
ctggtacctgccgggca

SEQ ID NO: 7983 - DNA, 17 bp, Artificial sequence
  Synthesized sequence
gtggcgccgggctggat

SEQ ID NO: 7984 - DNA, 17 bp, Artificial sequence
  Synthesized sequence
caggccggcaaggtgct

SEQ ID NO: 7985 - DNA, 17 bp, Artificial sequence
  Synthesized sequence
ctggggcggcatgggct

SEQ ID NO: 7986 - DNA, 17 bp, Artificial sequence
  Synthesized sequence
ctggcctgcgtgtcgga

SEQ ID NO: 7987 - DNA, 17 bp, Artificial sequence
  Synthesized sequence
ccggcacgctcaaggcg

SEQ ID NO: 7988 - DNA, 17 bp, Artificial sequence
  Synthesized sequence
acggcccgggcgtttcg

SEQ ID NO: 7989 - DNA, 17 bp, Artificial sequence
  Synthesized sequence
gcggcggacgcgttgcg

SEQ ID NO: 7990 - DNA, 17 bp, Artificial sequence
  Synthesized sequence
aaggtccgccgcgtgct

SEQ ID NO: 7991 - DNA, 17 bp, Artificial sequence
  Synthesized sequence
cgggcctagccgtggct

SEQ ID NO: 7992 - DNA, 17 bp, Artificial sequence
  Synthesized sequence
ctgccatggccagcgca

SEQ ID NO: 7993 - DNA, 17 bp, Artificial sequence
  Synthesized sequence
tcggcaaggatttcgaa

SEQ ID NO: 7994 - DNA, 17 bp, Artificial sequence
  Synthesized sequence
ctgccgcagatgctgcg

SEQ ID NO: 7995 - DNA, 17 bp, Artificial sequence
  Synthesized sequence
ctggaatcccttgcgct

SEQ ID NO: 7996 - DNA, 17 bp, Artificial sequence
  Synthesized sequence
gtgacagcgctggtgcc

SEQ ID NO: 7997 - DNA, 17 bp, Artificial sequence
  Synthesized sequence
gtgaaacagtcgttgaa

SEQ ID NO: 7998 - DNA, 17 bp, Artificial sequence
  Synthesized sequence
caggcgccggagtggct

SEQ ID NO: 7999 - DNA, 17 bp, Artificial sequence
  Synthesized sequence
acggcccgcttcacgct

SEQ ID NO: 8000 - DNA, 17 bp, Artificial sequence
  Synthesized sequence
ctggcacgtcttctcac

SEQ ID NO: 8001 - DNA, 17 bp, Artificial sequence
  Synthesized sequence
ttgacgcggaccttgac

SEQ ID NO: 8002 - DNA, 17 bp, Artificial sequence
  Synthesized sequence
tcggctcgtcattcgcc

SEQ ID NO: 8003 - DNA, 17 bp, Artificial sequence
  Synthesized sequence
gtggctccacgttcgtt

SEQ ID NO: 8004 - DNA, 17 bp, Artificial sequence
  Synthesized sequence
gcgggacgtcggctgcc

SEQ ID NO: 8005 - DNA, 17 bp, Artificial sequence
  Synthesized sequence
atggtcgaggagctgca

SEQ ID NO: 8006 - DNA, 17 bp, Artificial sequence
  Synthesized sequence
tttgcgaggctctttct

SEQ ID NO: 8007 - DNA, 17 bp, Artificial sequence
  Synthesized sequence
ccggctcgaccgtttcg

SEQ ID NO: 8008 - DNA, 17 bp, Artificial sequence
  Synthesized sequence
ctggaaagcttcgtcca

SEQ ID NO: 8009 - DNA, 17 bp, Artificial sequence
  Synthesized sequence
ctggtggaagtggtgca

SEQ ID NO: 8010 - DNA, 17 bp, Artificial sequence
  Synthesized sequence
ctggtggaagtggtgca

SEQ ID NO: 8011 - DNA, 17 bp, Artificial sequence
  Synthesized sequence
atggcgccgctgctggg

SEQ ID NO: 8012 - DNA, 17 bp, Artificial sequence
  Synthesized sequence
tcggcgcacttctggcg

SEQ ID NO: 8013 - DNA, 17 bp, Artificial sequence
  Synthesized sequence
ttggcgcaacgccttcg

SEQ ID NO: 8014 - DNA, 17 bp, Artificial sequence
  Synthesized sequence
cgcgcacatgttgtgca

SEQ ID NO: 8015 - DNA, 17 bp, Artificial sequence
  Synthesized sequence
gtcgccggggtgatgct

SEQ ID NO: 8016 - DNA, 17 bp, Artificial sequence
  Synthesized sequence
taggcactagacatgat

SEQ ID NO: 8017 - DNA, 17 bp, Artificial sequence
  Synthesized sequence
cttgcatggggcgcgct

SEQ ID NO: 8018 - DNA, 17 bp, Artificial sequence
  Synthesized sequence
tatgctcggcggttgcc

SEQ ID NO: 8019 - DNA, 17 bp, Artificial sequence
  Synthesized sequence
agggcaggtgttttccg

SEQ ID NO: 8020 - DNA, 17 bp, Artificial sequence
  Synthesized sequence
ctgggcaaaaagctgct

SEQ ID NO: 8021 - DNA, 17 bp, Artificial sequence
  Synthesized sequence
tcggcatcccgctggcc

SEQ ID NO: 8022 - DNA, 17 bp, Artificial sequence
  Synthesized sequence
atgtatcgccagttgcg

SEQ ID NO: 8023 - DNA, 17 bp, Artificial sequence
  Synthesized sequence
ctggcgccggcactaca

SEQ ID NO: 8024 - DNA, 17 bp, Artificial sequence
  Synthesized sequence
gaggcggaaatggtgct

SEQ ID NO: 8025 - DNA, 17 bp, Artificial sequence
  Synthesized sequence
tcggcaaggaccacgca

SEQ ID NO: 8026 - DNA, 17 bp, Artificial sequence
  Synthesized sequence
gcggccggcggcctgca

SEQ ID NO: 8027 - DNA, 17 bp, Artificial sequence
  Synthesized sequence
gcggcactgcttgcgcg

SEQ ID NO: 8028 - DNA, 17 bp, Artificial sequence
  Synthesized sequence
gtggcgaagatgacgct

SEQ ID NO: 8029 - DNA, 17 bp, Artificial sequence
  Synthesized sequence
ctggtgcaacccttccg

SEQ ID NO: 8030 - DNA, 17 bp, Artificial sequence
  Synthesized sequence
aaggcaaaccgttagcg

SEQ ID NO: 8031 - DNA, 17 bp, Artificial sequence
  Synthesized sequence
ctggcagataacgagcc

SEQ ID NO: 8032 - DNA, 17 bp, Artificial sequence
  Synthesized sequence
aaggcatgtcggcggct

SEQ ID NO: 8033 - DNA, 17 bp, Artificial sequence
  Synthesized sequence
gccgcgcggagcttgcc

SEQ ID NO: 8034 - DNA, 17 bp, Artificial sequence
  Synthesized sequence
ccggcccatcacctgcg

SEQ ID NO: 8035 - DNA, 17 bp, Artificial sequence
  Synthesized sequence
atggcggtgcgctggcg

SEQ ID NO: 8036 - DNA, 17 bp, Artificial sequence
  Synthesized sequence
ccggcctggcaactgcg

SEQ ID NO: 8037 - DNA, 17 bp, Artificial sequence
  Synthesized sequence
ttggcagcgctctaggc

SEQ ID NO: 8038 - DNA, 17 bp, Artificial sequence
  Synthesized sequence
ctggaggccgtgttgcg

SEQ ID NO: 8039 - DNA, 17 bp, Artificial sequence
  Synthesized sequence
atggaagaggagttccc

SEQ ID NO: 8040 - DNA, 17 bp, Artificial sequence
  Synthesized sequence
agcgcacggcgactgcc

SEQ ID NO: 8041 - DNA, 17 bp, Artificial sequence
  Synthesized sequence
ctggcccagcgactggg

SEQ ID NO: 8042 - DNA, 17 bp, Artificial sequence
  Synthesized sequence
ctggccagatagcggca

SEQ ID NO: 8043 - DNA, 17 bp, Artificial sequence
  Synthesized sequence
gcggaaagccgggtgct

SEQ ID NO: 8044 - DNA, 17 bp, Artificial sequence
  Synthesized sequence
ctggtcgaggaactgct

SEQ ID NO: 8045 - DNA, 17 bp, Artificial sequence
  Synthesized sequence
ctggtggaagacctgct

SEQ ID NO: 8046 - DNA, 17 bp, Artificial sequence
  Synthesized sequence
atcgcctgggagctgca

SEQ ID NO: 8047 - DNA, 17 bp, Artificial sequence
  Synthesized sequence
gtggccggacggccgca

SEQ ID NO: 8048 - DNA, 17 bp, Artificial sequence
  Synthesized sequence
ctggtcaatctctggct

SEQ ID NO: 8049 - DNA, 17 bp, Artificial sequence
  Synthesized sequence
ctggaacagacgccgcc

SEQ ID NO: 8050 - DNA, 17 bp, Artificial sequence
  Synthesized sequence
atggctcgggggctggc

SEQ ID NO: 8051 - DNA, 17 bp, Artificial sequence
  Synthesized sequence
gcggcacgggggcggcg

SEQ ID NO: 8052 - DNA, 17 bp, Artificial sequence
  Synthesized sequence
atgttgcgcatcctgct

SEQ ID NO: 8053 - DNA, 17 bp, Artificial sequence
  Synthesized sequence
ccggcgccatgatggct

SEQ ID NO: 8054 - DNA, 17 bp, Artificial sequence
  Synthesized sequence
ttggccggcgccatgat

SEQ ID NO: 8055 - DNA, 17 bp, Artificial sequence
  Synthesized sequence
tcggcatgctgccttct

SEQ ID NO: 8056 - DNA, 17 bp, Artificial sequence
  Synthesized sequence
gaggtgcggcgggtgct

SEQ ID NO: 8057 - DNA, 17 bp, Artificial sequence
  Synthesized sequence
aaggcccgggttgcgct

SEQ ID NO: 8058 - DNA, 17 bp, Artificial sequence
  Synthesized sequence
tgcgcacgcgcgttcct

SEQ ID NO: 8059 - DNA, 17 bp, Artificial sequence
  Synthesized sequence
ctgggacgccgactacc

SEQ ID NO: 8060 - DNA, 17 bp, Artificial sequence
  Synthesized sequence
gtggcccgcgcggagcg

SEQ ID NO: 8061 - DNA, 17 bp, Artificial sequence
  Synthesized sequence
ccggccgtacgcttgcc

SEQ ID NO: 8062 - DNA, 17 bp, Artificial sequence
  Synthesized sequence
ttggcaagagagtctcc

SEQ ID NO: 8063 - DNA, 17 bp, Artificial sequence
  Synthesized sequence
tgggcaggcgtccagct

SEQ ID NO: 8064 - DNA, 17 bp, Artificial sequence
  Synthesized sequence
gttgcaacgctctggcc

SEQ ID NO: 8065 - DNA, 17 bp, Artificial sequence
  Synthesized sequence
ttgacaagatcattgtg

SEQ ID NO: 8066 - DNA, 17 bp, Artificial sequence
  Synthesized sequence
tcggcgcgggaattgac

SEQ ID NO: 8067 - DNA, 17 bp, Artificial sequence
  Synthesized sequence
gtggccagcaaccagca

SEQ ID NO: 8068 - DNA, 17 bp, Artificial sequence
  Synthesized sequence
ctggcgatcgtggtgcc

SEQ ID NO: 8069 - DNA, 17 bp, Artificial sequence
  Synthesized sequence
gtggcgacgtactggcc

SEQ ID NO: 8070 - DNA, 17 bp, Artificial sequence
  Synthesized sequence
gtggcttcaaggtggcg

SEQ ID NO: 8071 - DNA, 17 bp, Artificial sequence
  Synthesized sequence
ctggcgcacccgtatca

SEQ ID NO: 8072 - DNA, 17 bp, Artificial sequence
  Synthesized sequence
gtggctgggggccggca

SEQ ID NO: 8073 - DNA, 17 bp, Artificial sequence
  Synthesized sequence
agggcctgttcctggct

SEQ ID NO: 8074 - DNA, 17 bp, Artificial sequence
  Synthesized sequence
ctgggcgacctgtcgct

SEQ ID NO: 8075 - DNA, 17 bp, Artificial sequence
  Synthesized sequence
atggcgatttcgtttct

SEQ ID NO: 8076 - DNA, 17 bp, Artificial sequence
  Synthesized sequence
atcgctagaatctcgct

SEQ ID NO: 8077 - DNA, 17 bp, Artificial sequence
  Synthesized sequence
atcgctagaatctcgct

SEQ ID NO: 8078 - DNA, 17 bp, Artificial sequence
  Synthesized sequence
gtggccaagcgcaagct

SEQ ID NO: 8079 - DNA, 17 bp, Artificial sequence
  Synthesized sequence
atggaccgcctggtggt

SEQ ID NO: 8080 - DNA, 17 bp, Artificial sequence
  Synthesized sequence
gtggtcgccatcgtgct

SEQ ID NO: 8081 - DNA, 17 bp, Artificial sequence
  Synthesized sequence
cagggccgcctgtcgct

SEQ ID NO: 8082 - DNA, 17 bp, Artificial sequence
  Synthesized sequence
ctgggaggaaacctcca

SEQ ID NO: 8083 - DNA, 17 bp, Artificial sequence
  Synthesized sequence
ctgaccccggcgctgct

SEQ ID NO: 8084 - DNA, 17 bp, Artificial sequence
  Synthesized sequence
gcggcagcgaactggcg

SEQ ID NO: 8085 - DNA, 17 bp, Artificial sequence
  Synthesized sequence
ctgggacaccatccgcc

SEQ ID NO: 8086 - DNA, 17 bp, Artificial sequence
  Synthesized sequence
atggcagactggcggcc

SEQ ID NO: 8087 - DNA, 17 bp, Artificial sequence
  Synthesized sequence
ctggccgccctgttccg

SEQ ID NO: 8088 - DNA, 17 bp, Artificial sequence
  Synthesized sequence
atggtccgcgtgcagct

SEQ ID NO: 8089 - DNA, 17 bp, Artificial sequence
  Synthesized sequence
gtggcgcgcccgtcacg

SEQ ID NO: 8090 - DNA, 17 bp, Artificial sequence
  Synthesized sequence
ttgctgggccagttgct

SEQ ID NO: 8091 - DNA, 17 bp, Artificial sequence
  Synthesized sequence
acggcatcgagttcgcc

SEQ ID NO: 8092 - DNA, 17 bp, Artificial sequence
  Synthesized sequence
ggggtacggcacatgaa

SEQ ID NO: 8093 - DNA, 17 bp, Artificial sequence
  Synthesized sequence
ccggctcggtgatcgcc

SEQ ID NO: 8094 - DNA, 17 bp, Artificial sequence
  Synthesized sequence
ttggcgacgcgctttcg

SEQ ID NO: 8095 - DNA, 17 bp, Artificial sequence
  Synthesized sequence
ctggaagctggcttcct

SEQ ID NO: 8096 - DNA, 17 bp, Artificial sequence
  Synthesized sequence
gcggctcggggatcgcg

SEQ ID NO: 8097 - DNA, 17 bp, Artificial sequence
  Synthesized sequence
cttgggcgggtcctgct

SEQ ID NO: 8098 - DNA, 17 bp, Artificial sequence
  Synthesized sequence
gtggccagggccaagca

SEQ ID NO: 8099 - DNA, 17 bp, Artificial sequence
  Synthesized sequence
ctcgccctggcgctgca

SEQ ID NO: 8100 - DNA, 17 bp, Artificial sequence
  Synthesized sequence
gaggcaccccgcctcca

SEQ ID NO: 8101 - DNA, 17 bp, Artificial sequence
  Synthesized sequence
ttggcatgaatagttgt

SEQ ID NO: 8102 - DNA, 17 bp, Artificial sequence
  Synthesized sequence
gtggaaccgcacctggg

SEQ ID NO: 8103 - DNA, 17 bp, Artificial sequence
  Synthesized sequence
gtgggcagcgaggtgca

SEQ ID NO: 8104 - DNA, 17 bp, Artificial sequence
  Synthesized sequence
ttggagcatccgctgcg

SEQ ID NO: 8105 - DNA, 17 bp, Artificial sequence
  Synthesized sequence
ctggagccgccggtgcg

SEQ ID NO: 8106 - DNA, 17 bp, Artificial sequence
  Synthesized sequence
aaggcgcgctgctggcc

SEQ ID NO: 8107 - DNA, 17 bp, Artificial sequence
  Synthesized sequence
tcggtgcggcgggtgct

SEQ ID NO: 8108 - DNA, 17 bp, Artificial sequence
  Synthesized sequence
taggcgcgaccgtttcc

SEQ ID NO: 8109 - DNA, 17 bp, Artificial sequence
  Synthesized sequence
taggcgcgaccgtttcc

SEQ ID NO: 8110 - DNA, 17 bp, Artificial sequence
  Synthesized sequence
gaggcggacggcttgcg

SEQ ID NO: 8111 - DNA, 17 bp, Artificial sequence
  Synthesized sequence
attgtccgatcgttgcc

SEQ ID NO: 8112 - DNA, 17 bp, Artificial sequence
  Synthesized sequence
gttgcatgaaacaggca

SEQ ID NO: 8113 - DNA, 17 bp, Artificial sequence
  Synthesized sequence
gttgcctgtttcatgca

SEQ ID NO: 8114 - DNA, 17 bp, Artificial sequence
  Synthesized sequence
aaggcagcgcgctggcg

SEQ ID NO: 8115 - DNA, 17 bp, Artificial sequence
  Synthesized sequence
tcggcgcgcgagtggcg

SEQ ID NO: 8116 - DNA, 17 bp, Artificial sequence
  Synthesized sequence
aaggcgttgctgatgca

SEQ ID NO: 8117 - DNA, 17 bp, Artificial sequence
  Synthesized sequence
atggcgaagctgaagca

SEQ ID NO: 8118 - DNA, 17 bp, Artificial sequence
  Synthesized sequence
cgggcccggctgctgaa

SEQ ID NO: 8119 - DNA, 17 bp, Artificial sequence
  Synthesized sequence
atggtccgggcccggct

SEQ ID NO: 8120 - DNA, 17 bp, Artificial sequence
  Synthesized sequence
gcggcacgccgtctccg

SEQ ID NO: 8121 - DNA, 17 bp, Artificial sequence
  Synthesized sequence
ctgtcaaggctcgggca

SEQ ID NO: 8122 - DNA, 17 bp, Artificial sequence
  Synthesized sequence
gaggcccggctgctgga

SEQ ID NO: 8123 - DNA, 17 bp, Artificial sequence
  Synthesized sequence
tgggcgcatacattgaa

SEQ ID NO: 8124 - DNA, 17 bp, Artificial sequence
  Synthesized sequence
caggaaggggcgctgca

SEQ ID NO: 8125 - DNA, 17 bp, Artificial sequence
  Synthesized sequence
tgggaaaaggtcatgca

SEQ ID NO: 8126 - DNA, 17 bp, Artificial sequence
  Synthesized sequence
atgtcaatgtgatcgct

SEQ ID NO: 8127 - DNA, 17 bp, Artificial sequence
  Synthesized sequence
caggtacgcctgctgtt

SEQ ID NO: 8128 - DNA, 17 bp, Artificial sequence
  Synthesized sequence
gtggctcgaacgctggc

SEQ ID NO: 8129 - DNA, 17 bp, Artificial sequence
  Synthesized sequence
atggacctgccgctgcg

SEQ ID NO: 8130 - DNA, 17 bp, Artificial sequence
  Synthesized sequence
ccggaacaggccatgcc

SEQ ID NO: 8131 - DNA, 17 bp, Artificial sequence
  Synthesized sequence
ctggcgctggcgatcct

SEQ ID NO: 8132 - DNA, 17 bp, Artificial sequence
  Synthesized sequence
ccggtacgcttcctgat

SEQ ID NO: 8133 - DNA, 17 bp, Artificial sequence
  Synthesized sequence
cttgcacgcttcgggcc

SEQ ID NO: 8134 - DNA, 17 bp, Artificial sequence
  Synthesized sequence
gtggcgagacgcctgga

SEQ ID NO: 8135 - DNA, 17 bp, Artificial sequence
  Synthesized sequence
ctgccccaggccttgta

SEQ ID NO: 8136 - DNA, 17 bp, Artificial sequence
  Synthesized sequence
attgctggcgcattgcc

SEQ ID NO: 8137 - DNA, 17 bp, Artificial sequence
  Synthesized sequence
gcggcatcctctatgcg

SEQ ID NO: 8138 - DNA, 17 bp, Artificial sequence
  Synthesized sequence
atgacacggccgaggcc

SEQ ID NO: 8139 - DNA, 17 bp, Artificial sequence
  Synthesized sequence
gtggcatcgccctctcc

SEQ ID NO: 8140 - DNA, 17 bp, Artificial sequence
  Synthesized sequence
ctggcccaggccctggc

SEQ ID NO: 8141 - DNA, 17 bp, Artificial sequence
  Synthesized sequence
gcggcacatccactcca

SEQ ID NO: 8142 - DNA, 17 bp, Artificial sequence
  Synthesized sequence
ggcgccggcctgttgct

SEQ ID NO: 8143 - DNA, 17 bp, Artificial sequence
  Synthesized sequence
tttgcagcctgtctgca

SEQ ID NO: 8144 - DNA, 17 bp, Artificial sequence
  Synthesized sequence
acggcgcgctgttcgcc

SEQ ID NO: 8145 - DNA, 17 bp, Artificial sequence
  Synthesized sequence
ttggcgcgcacggagcc

SEQ ID NO: 8146 - DNA, 17 bp, Artificial sequence
  Synthesized sequence
atgtcaccgcatgtgaa

SEQ ID NO: 8147 - DNA, 17 bp, Artificial sequence
  Synthesized sequence
gtggcttcaccgtggcc

SEQ ID NO: 8148 - DNA, 17 bp, Artificial sequence
  Synthesized sequence
tcggccaggcggttggt

SEQ ID NO: 8149 - DNA, 17 bp, Artificial sequence
  Synthesized sequence
tggggaagtgggttgcg

SEQ ID NO: 8150 - DNA, 17 bp, Artificial sequence
  Synthesized sequence
ctggaagcccgcgtgcc

SEQ ID NO: 8151 - DNA, 17 bp, Artificial sequence
  Synthesized sequence
ctggcgtgggcgtcggt

SEQ ID NO: 8152 - DNA, 17 bp, Artificial sequence
  Synthesized sequence
ctggaccggcgtcggct

SEQ ID NO: 8153 - DNA, 17 bp, Artificial sequence
  Synthesized sequence
ccggctcgggcttcgcc

SEQ ID NO: 8154 - DNA, 17 bp, Artificial sequence
  Synthesized sequence
tccgcacatgacctgca

SEQ ID NO: 8155 - DNA, 17 bp, Artificial sequence
  Synthesized sequence
gtgccggtcgggttgct

SEQ ID NO: 8156 - DNA, 17 bp, Artificial sequence
  Synthesized sequence
ttggcgcgctgctggtg

SEQ ID NO: 8157 - DNA, 17 bp, Artificial sequence
  Synthesized sequence
gttgccatgattttgcc

SEQ ID NO: 8158 - DNA, 17 bp, Artificial sequence
  Synthesized sequence
ctgggagccttgctgcc

SEQ ID NO: 8159 - DNA, 17 bp, Artificial sequence
  Synthesized sequence
atggccgctgagttact

SEQ ID NO: 8160 - DNA, 17 bp, Artificial sequence
  Synthesized sequence
ctggcacgccttatcgc

SEQ ID NO: 8161 - DNA, 17 bp, Artificial sequence
  Synthesized sequence
ctgggcctgttgctgcg

SEQ ID NO: 8162 - DNA, 17 bp, Artificial sequence
  Synthesized sequence
tcggcacaaggaaagca

SEQ ID NO: 8163 - DNA, 17 bp, Artificial sequence
  Synthesized sequence
ctggcgccggctgttca

SEQ ID NO: 8164 - DNA, 17 bp, Artificial sequence
  Synthesized sequence
ctggaactgctgccgcc

SEQ ID NO: 8165 - DNA, 17 bp, Artificial sequence
  Synthesized sequence
gtggagaagaaactgct

SEQ ID NO: 8166 - DNA, 17 bp, Artificial sequence
  Synthesized sequence
gttccactggcgttgcc

SEQ ID NO: 8167 - DNA, 17 bp, Artificial sequence
  Synthesized sequence
ctcggccgcatcctgct

SEQ ID NO: 8168 - DNA, 17 bp, Artificial sequence
  Synthesized sequence
gtggcaagctttacggt

SEQ ID NO: 8169 - DNA, 17 bp, Artificial sequence
  Synthesized sequence
ccgaccggcctgttgct

SEQ ID NO: 8170 - DNA, 17 bp, Artificial sequence
  Synthesized sequence
gcggaaggtcgcctgct

SEQ ID NO: 8171 - DNA, 17 bp, Artificial sequence
  Synthesized sequence
tcggcgcgaccattacc

SEQ ID NO: 8172 - DNA, 17 bp, Artificial sequence
  Synthesized sequence
ttcgcgtaccacctgct

SEQ ID NO: 8173 - DNA, 17 bp, Artificial sequence
  Synthesized sequence
gcggtagacgtcctgct

SEQ ID NO: 8174 - DNA, 17 bp, Artificial sequence
  Synthesized sequence
ccggaacttccctcgca

SEQ ID NO: 8175 - DNA, 17 bp, Artificial sequence
  Synthesized sequence
gaggcccacccgctgcg

SEQ ID NO: 8176 - DNA, 17 bp, Artificial sequence
  Synthesized sequence
gtggcccaccgcaagcc

SEQ ID NO: 8177 - DNA, 17 bp, Artificial sequence
  Synthesized sequence
acggcgcggcatccgct

SEQ ID NO: 8178 - DNA, 17 bp, Artificial sequence
  Synthesized sequence
ctggcgctgaacttcgt

SEQ ID NO: 8179 - DNA, 17 bp, Artificial sequence
  Synthesized sequence
atggcgatgccctggcc

SEQ ID NO: 8180 - DNA, 17 bp, Artificial sequence
  Synthesized sequence
caggccggcggcctgct

SEQ ID NO: 8181 - DNA, 17 bp, Artificial sequence
  Synthesized sequence
cagggaagactctttca

SEQ ID NO: 8182 - DNA, 17 bp, Artificial sequence
  Synthesized sequence
ctggcgctgggggtgaa

SEQ ID NO: 8183 - DNA, 17 bp, Artificial sequence
  Synthesized sequence
atggtccagggttggcg

SEQ ID NO: 8184 - DNA, 17 bp, Artificial sequence
  Synthesized sequence
tacgcctgccagttgct

SEQ ID NO: 8185 - DNA, 17 bp, Artificial sequence
  Synthesized sequence
aaggccgggcatttcct

SEQ ID NO: 8186 - DNA, 17 bp, Artificial sequence
  Synthesized sequence
gaggcacgcgggccgcg

SEQ ID NO: 8187 - DNA, 17 bp, Artificial sequence
  Synthesized sequence
ctggcatgccctgggta

SEQ ID NO: 8188 - DNA, 17 bp, Artificial sequence
  Synthesized sequence
gaggcatttcccctgcc

SEQ ID NO: 8189 - DNA, 17 bp, Artificial sequence
  Synthesized sequence
atggcctcgatcccgca

SEQ ID NO: 8190 - DNA, 17 bp, Artificial sequence
  Synthesized sequence
gtggcgaagttcgagca

SEQ ID NO: 8191 - DNA, 17 bp, Artificial sequence
  Synthesized sequence
atggccaggcattggat

SEQ ID NO: 8192 - DNA, 17 bp, Artificial sequence
  Synthesized sequence
gtggccttgctggcgct

SEQ ID NO: 8193 - DNA, 17 bp, Artificial sequence
  Synthesized sequence
caggccgacctgctgca

SEQ ID NO: 8194 - DNA, 17 bp, Artificial sequence
  Synthesized sequence
ggggcggggagcttgat

SEQ ID NO: 8195 - DNA, 17 bp, Artificial sequence
  Synthesized sequence
atgccgccaccggtgca

SEQ ID NO: 8196 - DNA, 17 bp, Artificial sequence
  Synthesized sequence
ctggtgggaccgttgta

SEQ ID NO: 8197 - DNA, 17 bp, Artificial sequence
  Synthesized sequence
gtcccgcagtcgttgct

SEQ ID NO: 8198 - DNA, 17 bp, Artificial sequence
  Synthesized sequence
gtcgcgggcgtcctgca

SEQ ID NO: 8199 - DNA, 17 bp, Artificial sequence
  Synthesized sequence
ttggcaccacgcgtcat

SEQ ID NO: 8200 - DNA, 17 bp, Artificial sequence
  Synthesized sequence
cgagcacgccaagtgcg

SEQ ID NO: 8201 - DNA, 17 bp, Artificial sequence
  Synthesized sequence
cccgctcatccattgct

SEQ ID NO: 8202 - DNA, 17 bp, Artificial sequence
  Synthesized sequence
tcggcgcggcttcagca

SEQ ID NO: 8203 - DNA, 17 bp, Artificial sequence
  Synthesized sequence
ctggccgggcatgtcca

SEQ ID NO: 8204 - DNA, 17 bp, Artificial sequence
  Synthesized sequence
caggcttgggggatgca

SEQ ID NO: 8205 - DNA, 17 bp, Artificial sequence
  Synthesized sequence
gcggcacatccgcttca

SEQ ID NO: 8206 - DNA, 17 bp, Artificial sequence
  Synthesized sequence
ggtgtacacggtttgca

SEQ ID NO: 8207 - DNA, 17 bp, Artificial sequence
  Synthesized sequence
ccggcctgaccgttcca

SEQ ID NO: 8208 - DNA, 17 bp, Artificial sequence
  Synthesized sequence
ctgtaaccgtcctcgca

SEQ ID NO: 8209 - DNA, 17 bp, Artificial sequence
  Synthesized sequence
gcggcgaacaggttgcg

SEQ ID NO: 8210 - DNA, 17 bp, Artificial sequence
  Synthesized sequence
ttcgagcggcacgtgct

SEQ ID NO: 8211 - DNA, 17 bp, Artificial sequence
  Synthesized sequence
gcggaacaggcgctgcc

SEQ ID NO: 8212 - DNA, 17 bp, Artificial sequence
  Synthesized sequence
ctggttcggcgccggca

SEQ ID NO: 8213 - DNA, 17 bp, Artificial sequence
  Synthesized sequence
gtgggacgccgctgccg

SEQ ID NO: 8214 - DNA, 17 bp, Artificial sequence
  Synthesized sequence
ctggcccgttcgcggcg

SEQ ID NO: 8215 - DNA, 17 bp, Artificial sequence
  Synthesized sequence
gcggtgcgcgtggtgct

SEQ ID NO: 8216 - DNA, 17 bp, Artificial sequence
  Synthesized sequence
gtgccgctgtcctggct

SEQ ID NO: 8217 - DNA, 17 bp, Artificial sequence
  Synthesized sequence
ctggccgagcatccgca

SEQ ID NO: 8218 - DNA, 17 bp, Artificial sequence
  Synthesized sequence
ccggggcagatcctgct

SEQ ID NO: 8219 - DNA, 17 bp, Artificial sequence
  Synthesized sequence
ctggtgcaatgggtgcg

SEQ ID NO: 8220 - DNA, 17 bp, Artificial sequence
  Synthesized sequence
gaggcctgaggatcgct

SEQ ID NO: 8221 - DNA, 17 bp, Artificial sequence
  Synthesized sequence
ctggcgacgatattgtc

SEQ ID NO: 8222 - DNA, 17 bp, Artificial sequence
  Synthesized sequence
gcgggatgctcagtgca

SEQ ID NO: 8223 - DNA, 17 bp, Artificial sequence
  Synthesized sequence
gcggcgcgactgccgca

SEQ ID NO: 8224 - DNA, 17 bp, Artificial sequence
  Synthesized sequence
atggggggactcctgcg

SEQ ID NO: 8225 - DNA, 17 bp, Artificial sequence
  Synthesized sequence
ctgctgcggcccctgct

SEQ ID NO: 8226 - DNA, 17 bp, Artificial sequence
  Synthesized sequence
ctggaccgccaccagca

SEQ ID NO: 8227 - DNA, 17 bp, Artificial sequence
  Synthesized sequence
ctgtcccgcgacctgcc

SEQ ID NO: 8228 - DNA, 17 bp, Artificial sequence
  Synthesized sequence
ctggctcgaacgctacc

SEQ ID NO: 8229 - DNA, 17 bp, Artificial sequence
  Synthesized sequence
acggcgcgctccttgac

SEQ ID NO: 8230 - DNA, 17 bp, Artificial sequence
  Synthesized sequence
ctgccagggaccttccc

SEQ ID NO: 8231 - DNA, 17 bp, Artificial sequence
  Synthesized sequence
atggcacgaaagccccg

SEQ ID NO: 8232 - DNA, 17 bp, Artificial sequence
  Synthesized sequence
ctggatcgactggcgca

SEQ ID NO: 8233 - DNA, 17 bp, Artificial sequence
  Synthesized sequence
acggcaccccgctggat

SEQ ID NO: 8234 - DNA, 17 bp, Artificial sequence
  Synthesized sequence
gtggtattagttttccc

SEQ ID NO: 8235 - DNA, 17 bp, Artificial sequence
  Synthesized sequence
ctggccacgcagttggg

SEQ ID NO: 8236 - DNA, 17 bp, Artificial sequence
  Synthesized sequence
ttgtcccgccgactgcc

SEQ ID NO: 8237 - DNA, 17 bp, Artificial sequence
  Synthesized sequence
ccgggaccttctctgct

SEQ ID NO: 8238 - DNA, 17 bp, Artificial sequence
  Synthesized sequence
ctgtcatggccaatgat

SEQ ID NO: 8239 - DNA, 17 bp, Artificial sequence
  Synthesized sequence
ctggcctacagcgggct

SEQ ID NO: 8240 - DNA, 17 bp, Artificial sequence
  Synthesized sequence
ccggcgcgggcatggcc

SEQ ID NO: 8241 - DNA, 17 bp, Artificial sequence
  Synthesized sequence
tgggctcgatgttcgcc

SEQ ID NO: 8242 - DNA, 17 bp, Artificial sequence
  Synthesized sequence
atggcagcgcggcagcg

SEQ ID NO: 8243 - DNA, 17 bp, Artificial sequence
  Synthesized sequence
ctggctggaccggcgca

SEQ ID NO: 8244 - DNA, 17 bp, Artificial sequence
  Synthesized sequence
tcgccaccgacaatgct

SEQ ID NO: 8245 - DNA, 17 bp, Artificial sequence
  Synthesized sequence
ctggagcgcatcgagct

SEQ ID NO: 8246 - DNA, 17 bp, Artificial sequence
  Synthesized sequence
ctggaacaacgcctgtc

SEQ ID NO: 8247 - DNA, 17 bp, Artificial sequence
  Synthesized sequence
cccgcacctctgctgct

SEQ ID NO: 8248 - DNA, 17 bp, Artificial sequence
  Synthesized sequence
atcgcacaagggcggct

SEQ ID NO: 8249 - DNA, 17 bp, Artificial sequence
  Synthesized sequence
ctggcgatcaccatgcg

SEQ ID NO: 8250 - DNA, 17 bp, Artificial sequence
  Synthesized sequence
ctggcccgcgcctcgtc

SEQ ID NO: 8251 - DNA, 17 bp, Artificial sequence
  Synthesized sequence
agggcacccccgccgca

SEQ ID NO: 8252 - DNA, 17 bp, Artificial sequence
  Synthesized sequence
gttgcacaagggcggct

SEQ ID NO: 8253 - DNA, 17 bp, Artificial sequence
  Synthesized sequence
cgggcatccatgtggcg

SEQ ID NO: 8254 - DNA, 17 bp, Artificial sequence
  Synthesized sequence
atggcacgggccgcccc

SEQ ID NO: 8255 - DNA, 17 bp, Artificial sequence
  Synthesized sequence
tttccacgctgctggct

SEQ ID NO: 8256 - DNA, 17 bp, Artificial sequence
  Synthesized sequence
atcgccggtatcgtgct

SEQ ID NO: 8257 - DNA, 17 bp, Artificial sequence
  Synthesized sequence
cggggaaaagcgttgcc

SEQ ID NO: 8258 - DNA, 17 bp, Artificial sequence
  Synthesized sequence
ttggttcggcctgcgca

SEQ ID NO: 8259 - DNA, 17 bp, Artificial sequence
  Synthesized sequence
ctggccgccgccctgcc

SEQ ID NO: 8260 - DNA, 17 bp, Artificial sequence
  Synthesized sequence
gtggccgaactggtggt

SEQ ID NO: 8261 - DNA, 17 bp, Artificial sequence
  Synthesized sequence
tcggcaccgcgttcggt

SEQ ID NO: 8262 - DNA, 17 bp, Artificial sequence
  Synthesized sequence
ccggcgcgctgttcgcg

SEQ ID NO: 8263 - DNA, 17 bp, Artificial sequence
  Synthesized sequence
ttcgccctggccctgca

SEQ ID NO: 8264 - DNA, 17 bp, Artificial sequence
  Synthesized sequence
gtggcgccagaggcgca

SEQ ID NO: 8265 - DNA, 17 bp, Artificial sequence
  Synthesized sequence
gaggaactcatcctgcg

SEQ ID NO: 8266 - DNA, 17 bp, Artificial sequence
  Synthesized sequence
ggggcaagggttgggca

SEQ ID NO: 8267 - DNA, 17 bp, Artificial sequence
  Synthesized sequence
ttgaaacggcccttggc

SEQ ID NO: 8268 - DNA, 17 bp, Artificial sequence
  Synthesized sequence
tcggccagattgtcgca

SEQ ID NO: 8269 - DNA, 17 bp, Artificial sequence
  Synthesized sequence
ggggggcgcggtttgcg

SEQ ID NO: 8270 - DNA, 17 bp, Artificial sequence
  Synthesized sequence
catggacgtctattgcg

SEQ ID NO: 8271 - DNA, 17 bp, Artificial sequence
  Synthesized sequence
ccggcgggcctattcct

SEQ ID NO: 8272 - DNA, 17 bp, Artificial sequence
  Synthesized sequence
gtggccgggcatgtcca

SEQ ID NO: 8273 - DNA, 17 bp, Artificial sequence
  Synthesized sequence
ctggcgggacaaatggt

SEQ ID NO: 8274 - DNA, 17 bp, Artificial sequence
  Synthesized sequence
ggggaacgaggctggcg

SEQ ID NO: 8275 - DNA, 17 bp, Artificial sequence
  Synthesized sequence
gtggaactgctggcgcg

SEQ ID NO: 8276 - DNA, 17 bp, Artificial sequence
  Synthesized sequence
ctggcccggcgtttctc

SEQ ID NO: 8277 - DNA, 17 bp, Artificial sequence
  Synthesized sequence
atcgatcatgagttgct

SEQ ID NO: 8278 - DNA, 17 bp, Artificial sequence
  Synthesized sequence
ctggacaaccgcctgca

SEQ ID NO: 8279 - DNA, 17 bp, Artificial sequence
  Synthesized sequence
ctggcggcttccttcca

SEQ ID NO: 8280 - DNA, 17 bp, Artificial sequence
  Synthesized sequence
ctggcccgctggctacc

SEQ ID NO: 8281 - DNA, 17 bp, Artificial sequence
  Synthesized sequence
gctgcactacctgtgct

SEQ ID NO: 8282 - DNA, 17 bp, Artificial sequence
  Synthesized sequence
ttggcacccttgggact

SEQ ID NO: 8283 - DNA, 17 bp, Artificial sequence
  Synthesized sequence
ggggtactcccttagca

SEQ ID NO: 8284 - DNA, 17 bp, Artificial sequence
  Synthesized sequence
atggccgtttcgttgaa

SEQ ID NO: 8285 - DNA, 17 bp, Artificial sequence
  Synthesized sequence
gtggccctggcgctgaa

SEQ ID NO: 8286 - DNA, 17 bp, Artificial sequence
  Synthesized sequence
cgggcgcgaccattgtc

SEQ ID NO: 8287 - DNA, 17 bp, Artificial sequence
  Synthesized sequence
cagggcctgctgttgcc

SEQ ID NO: 8288 - DNA, 17 bp, Artificial sequence
  Synthesized sequence
gtggccgccggcatgcg

SEQ ID NO: 8289 - DNA, 17 bp, Artificial sequence
  Synthesized sequence
gtggcgtggcggtcgga

SEQ ID NO: 8290 - DNA, 17 bp, Artificial sequence
  Synthesized sequence
ggggcgggcacggtgct

SEQ ID NO: 8291 - DNA, 17 bp, Artificial sequence
  Synthesized sequence
atggcgccgctggagcg

SEQ ID NO: 8292 - DNA, 17 bp, Artificial sequence
  Synthesized sequence
atggcgccgctggagcg

SEQ ID NO: 8293 - DNA, 17 bp, Artificial sequence
  Synthesized sequence
atcgagcgggtcctgct

SEQ ID NO: 8294 - DNA, 17 bp, Artificial sequence
  Synthesized sequence
gaggctcccgcctggct

SEQ ID NO: 8295 - DNA, 17 bp, Artificial sequence
  Synthesized sequence
ccgtcatattttttgcg

SEQ ID NO: 8296 - DNA, 17 bp, Artificial sequence
  Synthesized sequence
gcgggccgggccctgct

SEQ ID NO: 8297 - DNA, 17 bp, Artificial sequence
  Synthesized sequence
atggcgtgcggcctgaa

SEQ ID NO: 8298 - DNA, 17 bp, Artificial sequence
  Synthesized sequence
gaggaactgcgcctgcg

SEQ ID NO: 8299 - DNA, 17 bp, Artificial sequence
  Synthesized sequence
ctggtgttgatcttcct

SEQ ID NO: 8300 - DNA, 17 bp, Artificial sequence
  Synthesized sequence
ctggacctgccggtgcc

SEQ ID NO: 8301 - DNA, 17 bp, Artificial sequence
  Synthesized sequence
gtagcacgacatgagcc

SEQ ID NO: 8302 - DNA, 17 bp, Artificial sequence
  Synthesized sequence
ctgccgagtgccttgcc

SEQ ID NO: 8303 - DNA, 17 bp, Artificial sequence
  Synthesized sequence
ctggcgctgttcgcgcc

SEQ ID NO: 8304 - DNA, 17 bp, Artificial sequence
  Synthesized sequence
gtcgcgctcgccatgct

SEQ ID NO: 8305 - DNA, 17 bp, Artificial sequence
  Synthesized sequence
ctggccgagctggcgca

SEQ ID NO: 8306 - DNA, 17 bp, Artificial sequence
  Synthesized sequence
gccgcacagacctttca

SEQ ID NO: 8307 - DNA, 17 bp, Artificial sequence
  Synthesized sequence
gtggacgaagtggtgct

SEQ ID NO: 8308 - DNA, 17 bp, Artificial sequence
  Synthesized sequence
ctgttgcagcgcttgcc

SEQ ID NO: 8309 - DNA, 17 bp, Artificial sequence
  Synthesized sequence
ctggcaatgcaggggcg

SEQ ID NO: 8310 - DNA, 17 bp, Artificial sequence
  Synthesized sequence
cgggcaggtagatggcg

SEQ ID NO: 8311 - DNA, 17 bp, Artificial sequence
  Synthesized sequence
gtcgccccggaagtgct

SEQ ID NO: 8312 - DNA, 17 bp, Artificial sequence
  Synthesized sequence
ctcgccttgccattgcc

SEQ ID NO: 8313 - DNA, 17 bp, Artificial sequence
  Synthesized sequence
caggcaagatgttttcc

SEQ ID NO: 8314 - DNA, 17 bp, Artificial sequence
  Synthesized sequence
gcggcccacgccctgcg

SEQ ID NO: 8315 - DNA, 17 bp, Artificial sequence
  Synthesized sequence
ctggcccgcgagatccg

SEQ ID NO: 8316 - DNA, 17 bp, Artificial sequence
  Synthesized sequence
tgcgaaccgtagttgct

SEQ ID NO: 8317 - DNA, 17 bp, Artificial sequence
  Synthesized sequence
atggcatcatcggcgcc

SEQ ID NO: 8318 - DNA, 17 bp, Artificial sequence
  Synthesized sequence
aaggcggagcatgtgct

SEQ ID NO: 8319 - DNA, 17 bp, Artificial sequence
  Synthesized sequence
ctgccgcacccgttggt

SEQ ID NO: 8320 - DNA, 17 bp, Artificial sequence
  Synthesized sequence
ctcgcgcatgcctcgct

SEQ ID NO: 8321 - DNA, 17 bp, Artificial sequence
  Synthesized sequence
gcggcagccccgctgcg

SEQ ID NO: 8322 - DNA, 17 bp, Artificial sequence
  Synthesized sequence
cggggccggccctggct

SEQ ID NO: 8323 - DNA, 17 bp, Artificial sequence
  Synthesized sequence
ccggcctgttggatgct

SEQ ID NO: 8324 - DNA, 17 bp, Artificial sequence
  Synthesized sequence
cttgcagactttatgcc

SEQ ID NO: 8325 - DNA, 17 bp, Artificial sequence
  Synthesized sequence
agggcctgcaggttgat

SEQ ID NO: 8326 - DNA, 17 bp, Artificial sequence
  Synthesized sequence
ggagcaaatggattgct

SEQ ID NO: 8327 - DNA, 17 bp, Artificial sequence
  Synthesized sequence
acggcgcgatcatcgcc

SEQ ID NO: 8328 - DNA, 17 bp, Artificial sequence
  Synthesized sequence
ctggtcgagttcttcct

SEQ ID NO: 8329 - DNA, 17 bp, Artificial sequence
  Synthesized sequence
cgggcacatgctcggca

SEQ ID NO: 8330 - DNA, 17 bp, Artificial sequence
  Synthesized sequence
cgggcacatgctcggca

SEQ ID NO: 8331 - DNA, 17 bp, Artificial sequence
  Synthesized sequence
gtggctacgccttcgcc

SEQ ID NO: 8332 - DNA, 17 bp, Artificial sequence
  Synthesized sequence
ctggccgatcagttggg

SEQ ID NO: 8333 - DNA, 17 bp, Artificial sequence
  Synthesized sequence
ctggcgcgctactggac

SEQ ID NO: 8334 - DNA, 17 bp, Artificial sequence
  Synthesized sequence
agggcatcgagctggcc

SEQ ID NO: 8335 - DNA, 17 bp, Artificial sequence
  Synthesized sequence
ctggcagatcgccggcc

SEQ ID NO: 8336 - DNA, 17 bp, Artificial sequence
  Synthesized sequence
aaggcaagaccgccgct

SEQ ID NO: 8337 - DNA, 17 bp, Artificial sequence
  Synthesized sequence
ccggcgcgcagcttgtc

SEQ ID NO: 8338 - DNA, 17 bp, Artificial sequence
  Synthesized sequence
gctgcgcgaagcttgcg

SEQ ID NO: 8339 - DNA, 17 bp, Artificial sequence
  Synthesized sequence
ctggcgcgctggctggc

SEQ ID NO: 8340 - DNA, 17 bp, Artificial sequence
  Synthesized sequence
gtggcttgcgacctgga

SEQ ID NO: 8341 - DNA, 17 bp, Artificial sequence
  Synthesized sequence
gtggcttgcgacctgga

SEQ ID NO: 8342 - DNA, 17 bp, Artificial sequence
  Synthesized sequence
cgggcaagcctgaggca

SEQ ID NO: 8343 - DNA, 17 bp, Artificial sequence
  Synthesized sequence
cgggggcacgtgttgcg

SEQ ID NO: 8344 - DNA, 17 bp, Artificial sequence
  Synthesized sequence
ggggcacgtgttgcgcc

SEQ ID NO: 8345 - DNA, 17 bp, Artificial sequence
  Synthesized sequence
ttggcgacggcgctgcg

SEQ ID NO: 8346 - DNA, 17 bp, Artificial sequence
  Synthesized sequence
ctggccggaaagctgga

SEQ ID NO: 8347 - DNA, 17 bp, Artificial sequence
  Synthesized sequence
acggaactcttttttca

SEQ ID NO: 8348 - DNA, 17 bp, Artificial sequence
  Synthesized sequence
ctggcaatgcctgcgcg

SEQ ID NO: 8349 - DNA, 17 bp, Artificial sequence
  Synthesized sequence
ttggcggcaccctggcc

SEQ ID NO: 8350 - DNA, 17 bp, Artificial sequence
  Synthesized sequence
gtgccaggcgcctcgcc

SEQ ID NO: 8351 - DNA, 17 bp, Artificial sequence
  Synthesized sequence
ctggcccgcgcagtgac

SEQ ID NO: 8352 - DNA, 17 bp, Artificial sequence
  Synthesized sequence
gtgacccgcagcgtgcc

SEQ ID NO: 8353 - DNA, 17 bp, Artificial sequence
  Synthesized sequence
atcgcactgaccccgca

SEQ ID NO: 8354 - DNA, 17 bp, Artificial sequence
  Synthesized sequence
atggccgtacattcgcc

SEQ ID NO: 8355 - DNA, 17 bp, Artificial sequence
  Synthesized sequence
gtggaagcggcgatgcc

SEQ ID NO: 8356 - DNA, 17 bp, Artificial sequence
  Synthesized sequence
gaggaaagaaagtcgct

SEQ ID NO: 8357 - DNA, 17 bp, Artificial sequence
  Synthesized sequence
ctgggctgggccatgcg

SEQ ID NO: 8358 - DNA, 17 bp, Artificial sequence
  Synthesized sequence
ctggcagcgcgcgggcc

SEQ ID NO: 8359 - DNA, 17 bp, Artificial sequence
  Synthesized sequence
ctggcctgcgcgccgca

SEQ ID NO: 8360 - DNA, 17 bp, Artificial sequence
  Synthesized sequence
tcggcatgaaggctgtt

SEQ ID NO: 8361 - DNA, 17 bp, Artificial sequence
  Synthesized sequence
atgccacgggtggcgcc

SEQ ID NO: 8362 - DNA, 17 bp, Artificial sequence
  Synthesized sequence
cttgttctctgcttgct

SEQ ID NO: 8363 - DNA, 17 bp, Artificial sequence
  Synthesized sequence
gaggactacgacttgct

SEQ ID NO: 8364 - DNA, 17 bp, Artificial sequence
  Synthesized sequence
ctgccacggcccctggc

SEQ ID NO: 8365 - DNA, 17 bp, Artificial sequence
  Synthesized sequence
tcggcacgctgcgtccg

SEQ ID NO: 8366 - DNA, 17 bp, Artificial sequence
  Synthesized sequence
ctggcgctggagtggat

SEQ ID NO: 8367 - DNA, 17 bp, Artificial sequence
  Synthesized sequence
atggcgctgctggagcg

SEQ ID NO: 8368 - DNA, 17 bp, Artificial sequence
  Synthesized sequence
ctggcgcttgtgctgtt

SEQ ID NO: 8369 - DNA, 17 bp, Artificial sequence
  Synthesized sequence
caggcctggcgcgtgcc

SEQ ID NO: 8370 - DNA, 17 bp, Artificial sequence
  Synthesized sequence
ctggcgcgaaggctacg

SEQ ID NO: 8371 - DNA, 17 bp, Artificial sequence
  Synthesized sequence
agggctcgacctttccc

SEQ ID NO: 8372 - DNA, 17 bp, Artificial sequence
  Synthesized sequence
ctgttcggcgtgttgct

SEQ ID NO: 8373 - DNA, 17 bp, Artificial sequence
  Synthesized sequence
ctgggcggtagcctgct

SEQ ID NO: 8374 - DNA, 17 bp, Artificial sequence
  Synthesized sequence
gcggcaacgcctgtgcc

SEQ ID NO: 8375 - DNA, 17 bp, Artificial sequence
  Synthesized sequence
gtagcccgggcgctgcc

SEQ ID NO: 8376 - DNA, 17 bp, Artificial sequence
  Synthesized sequence
gcggcagggaccgcgca

SEQ ID NO: 8377 - DNA, 17 bp, Artificial sequence
  Synthesized sequence
ctggcccaggccgcgcc

SEQ ID NO: 8378 - DNA, 17 bp, Artificial sequence
  Synthesized sequence
agggcacggcgatgggg

SEQ ID NO: 8379 - DNA, 17 bp, Artificial sequence
  Synthesized sequence
acggcaaaggcgtcgcc

SEQ ID NO: 8380 - DNA, 17 bp, Artificial sequence
  Synthesized sequence
atggcgtacgtcgagct

SEQ ID NO: 8381 - DNA, 17 bp, Artificial sequence
  Synthesized sequence
ctggagcgtcagttccg

SEQ ID NO: 8382 - DNA, 17 bp, Artificial sequence
  Synthesized sequence
ttggtcgcactactgct

SEQ ID NO: 8383 - DNA, 17 bp, Artificial sequence
  Synthesized sequence
gtgccacgttcactgaa

SEQ ID NO: 8384 - DNA, 17 bp, Artificial sequence
  Synthesized sequence
tgggtaaagccggtgct

SEQ ID NO: 8385 - DNA, 17 bp, Artificial sequence
  Synthesized sequence
aaggcgctcagatcgct

SEQ ID NO: 8386 - DNA, 17 bp, Artificial sequence
  Synthesized sequence
ctggccaagttcatgaa

SEQ ID NO: 8387 - DNA, 17 bp, Artificial sequence
  Synthesized sequence
gcggcgtacaccctgca

SEQ ID NO: 8388 - DNA, 17 bp, Artificial sequence
  Synthesized sequence
gtggcgcaagccttaaa

SEQ ID NO: 8389 - DNA, 17 bp, Artificial sequence
  Synthesized sequence
atggcgctgctgctgtg

SEQ ID NO: 8390 - DNA, 17 bp, Artificial sequence
  Synthesized sequence
ttggcgaggtgctcgat

SEQ ID NO: 8391 - DNA, 17 bp, Artificial sequence
  Synthesized sequence
ttcgccagcctgctgca

SEQ ID NO: 8392 - DNA, 17 bp, Artificial sequence
  Synthesized sequence
ctggctcgccagtggtg

SEQ ID NO: 8393 - DNA, 17 bp, Artificial sequence
  Synthesized sequence
ctggagcgatttccgca

SEQ ID NO: 8394 - DNA, 17 bp, Artificial sequence
  Synthesized sequence
gtggcgcgctcggtgtg

SEQ ID NO: 8395 - DNA, 17 bp, Artificial sequence
  Synthesized sequence
caggaaggcgcgctgct

SEQ ID NO: 8396 - DNA, 17 bp, Artificial sequence
  Synthesized sequence
gaggcagggctctgtct

SEQ ID NO: 8397 - DNA, 17 bp, Artificial sequence
  Synthesized sequence
gaggcagggctctgtct

SEQ ID NO: 8398 - DNA, 17 bp, Artificial sequence
  Synthesized sequence
gtcgcgccggcctggct

SEQ ID NO: 8399 - DNA, 17 bp, Artificial sequence
  Synthesized sequence
ccggcaggtgccttggc

SEQ ID NO: 8400 - DNA, 17 bp, Artificial sequence
  Synthesized sequence
ctgccgcgaagctcgcg

SEQ ID NO: 8401 - DNA, 17 bp, Artificial sequence
  Synthesized sequence
tgggcaactgaggtgca

SEQ ID NO: 8402 - DNA, 17 bp, Artificial sequence
  Synthesized sequence
atggcctgatgatcggt

SEQ ID NO: 8403 - DNA, 17 bp, Artificial sequence
  Synthesized sequence
tcggcggcgcagttgcc

SEQ ID NO: 8404 - DNA, 17 bp, Artificial sequence
  Synthesized sequence
ctggcgcctggcgcgct

SEQ ID NO: 8405 - DNA, 17 bp, Artificial sequence
  Synthesized sequence
atggcgacgtcctggcc

SEQ ID NO: 8406 - DNA, 17 bp, Artificial sequence
  Synthesized sequence
atggccagccgggcgct

SEQ ID NO: 8407 - DNA, 17 bp, Artificial sequence
  Synthesized sequence
gcggcccggtctttccc

SEQ ID NO: 8408 - DNA, 17 bp, Artificial sequence
  Synthesized sequence
ctgccgatgggattgca

SEQ ID NO: 8409 - DNA, 17 bp, Artificial sequence
  Synthesized sequence
ctggcgcgcgctgttcg

SEQ ID NO: 8410 - DNA, 17 bp, Artificial sequence
  Synthesized sequence
gcggccaggcgatcgct

SEQ ID NO: 8411 - DNA, 17 bp, Artificial sequence
  Synthesized sequence
ggggcgtgatgcttgta

SEQ ID NO: 8412 - DNA, 17 bp, Artificial sequence
  Synthesized sequence
acggaacggtcgtttcg

SEQ ID NO: 8413 - DNA, 17 bp, Artificial sequence
  Synthesized sequence
acggaacggtcgtttcg

SEQ ID NO: 8414 - DNA, 17 bp, Artificial sequence
  Synthesized sequence
gtggtccgcgtcgggca

SEQ ID NO: 8415 - DNA, 17 bp, Artificial sequence
  Synthesized sequence
gcggcgggctgcgtgct

SEQ ID NO: 8416 - DNA, 17 bp, Artificial sequence
  Synthesized sequence
agggcccgagcctggcc

SEQ ID NO: 8417 - DNA, 17 bp, Artificial sequence
  Synthesized sequence
ttcgccaaccagttgcg

SEQ ID NO: 8418 - DNA, 17 bp, Artificial sequence
  Synthesized sequence
tcggcatcgtgatcgcg

SEQ ID NO: 8419 - DNA, 17 bp, Artificial sequence
  Synthesized sequence
gtggcaagccttcatct

SEQ ID NO: 8420 - DNA, 17 bp, Artificial sequence
  Synthesized sequence
ctggggctgatgatgcc

SEQ ID NO: 8421 - DNA, 17 bp, Artificial sequence
  Synthesized sequence
gtgcctcgctttgtgcc

SEQ ID NO: 8422 - DNA, 17 bp, Artificial sequence
  Synthesized sequence
caggccgacattctgct

SEQ ID NO: 8423 - DNA, 17 bp, Artificial sequence
  Synthesized sequence
taggcgcgagcgtcgcc

SEQ ID NO: 8424 - DNA, 17 bp, Artificial sequence
  Synthesized sequence
atcgcgccgaagtcgct

SEQ ID NO: 8425 - DNA, 17 bp, Artificial sequence
  Synthesized sequence
ttggaacgcaggatgtc

SEQ ID NO: 8426 - DNA, 17 bp, Artificial sequence
  Synthesized sequence
tcggcatgcccgaggca

SEQ ID NO: 8427 - DNA, 17 bp, Artificial sequence
  Synthesized sequence
ctggtccggccgctgga

SEQ ID NO: 8428 - DNA, 17 bp, Artificial sequence
  Synthesized sequence
ctggtggaggacctgca

SEQ ID NO: 8429 - DNA, 17 bp, Artificial sequence
  Synthesized sequence
gaggcccacctgtggcc

SEQ ID NO: 8430 - DNA, 17 bp, Artificial sequence
  Synthesized sequence
agggcatcgacttcgcc

SEQ ID NO: 8431 - DNA, 17 bp, Artificial sequence
  Synthesized sequence
gtgggttgcaccttgaa

SEQ ID NO: 8432 - DNA, 17 bp, Artificial sequence
  Synthesized sequence
acggccagcgccgtgca

SEQ ID NO: 8433 - DNA, 17 bp, Artificial sequence
  Synthesized sequence
ttgctcagccagttgct

SEQ ID NO: 8434 - DNA, 17 bp, Artificial sequence
  Synthesized sequence
caggcacgcagcctggc

SEQ ID NO: 8435 - DNA, 17 bp, Artificial sequence
  Synthesized sequence
gcggcagggcgtgagct

SEQ ID NO: 8436 - DNA, 17 bp, Artificial sequence
  Synthesized sequence
agggcgtggctgatgcc

SEQ ID NO: 8437 - DNA, 17 bp, Artificial sequence
  Synthesized sequence
ctgccgcgcgacctgcc

SEQ ID NO: 8438 - DNA, 17 bp, Artificial sequence
  Synthesized sequence
ctgccgcgcgacctgcc

SEQ ID NO: 8439 - DNA, 17 bp, Artificial sequence
  Synthesized sequence
ctcgcgctcgttgtgct

SEQ ID NO: 8440 - DNA, 17 bp, Artificial sequence
  Synthesized sequence
ctgagatgctgcatgct

SEQ ID NO: 8441 - DNA, 17 bp, Artificial sequence
  Synthesized sequence
gttgaacgagatatgcg

SEQ ID NO: 8442 - DNA, 17 bp, Artificial sequence
  Synthesized sequence
ctggaagggcggctact

SEQ ID NO: 8443 - DNA, 17 bp, Artificial sequence
  Synthesized sequence
tcggcatggctgcggcg

SEQ ID NO: 8444 - DNA, 17 bp, Artificial sequence
  Synthesized sequence
ttcgcccgcctgttccg

SEQ ID NO: 8445 - DNA, 17 bp, Artificial sequence
  Synthesized sequence
ctggcaccgcaggagta

SEQ ID NO: 8446 - DNA, 17 bp, Artificial sequence
  Synthesized sequence
atggcgaccgacctgcg

SEQ ID NO: 8447 - DNA, 17 bp, Artificial sequence
  Synthesized sequence
agggcacggtctatccg

SEQ ID NO: 8448 - DNA, 17 bp, Artificial sequence
  Synthesized sequence
ttggccctgccttcgga

SEQ ID NO: 8449 - DNA, 17 bp, Artificial sequence
  Synthesized sequence
atggcggtgggcatgcc

SEQ ID NO: 8450 - DNA, 17 bp, Artificial sequence
  Synthesized sequence
gtggtggaccggctgct

SEQ ID NO: 8451 - DNA, 17 bp, Artificial sequence
  Synthesized sequence
atgccacgcaatttttt

SEQ ID NO: 8452 - DNA, 17 bp, Artificial sequence
  Synthesized sequence
aaggcgggcaatatgct

SEQ ID NO: 8453 - DNA, 17 bp, Artificial sequence
  Synthesized sequence
aaggcgggcaatatgct

SEQ ID NO: 8454 - DNA, 17 bp, Artificial sequence
  Synthesized sequence
cgggcagggactgggct

SEQ ID NO: 8455 - DNA, 17 bp, Artificial sequence
  Synthesized sequence
ctggtaccggcctacct

SEQ ID NO: 8456 - DNA, 17 bp, Artificial sequence
  Synthesized sequence
ctgcaactacctgtgca

SEQ ID NO: 8457 - DNA, 17 bp, Artificial sequence
  Synthesized sequence
tcggcaagtagttcgcc

SEQ ID NO: 8458 - DNA, 17 bp, Artificial sequence
  Synthesized sequence
tcggcagcgatgtggcg

SEQ ID NO: 8459 - DNA, 17 bp, Artificial sequence
  Synthesized sequence
ctggcctacccgaagct

SEQ ID NO: 8460 - DNA, 17 bp, Artificial sequence
  Synthesized sequence
atggcgtaccgccagct

SEQ ID NO: 8461 - DNA, 17 bp, Artificial sequence
  Synthesized sequence
aaggcgaaatgattgcc

SEQ ID NO: 8462 - DNA, 17 bp, Artificial sequence
  Synthesized sequence
ccggtatagcagttgaa

SEQ ID NO: 8463 - DNA, 17 bp, Artificial sequence
  Synthesized sequence
ctggtatcgacgttccg

SEQ ID NO: 8464 - DNA, 17 bp, Artificial sequence
  Synthesized sequence
tcggcggggctttttca

SEQ ID NO: 8465 - DNA, 17 bp, Artificial sequence
  Synthesized sequence
taggcgcaaggcctgcg

SEQ ID NO: 8466 - DNA, 17 bp, Artificial sequence
  Synthesized sequence
ctggtcggcaacttcct

SEQ ID NO: 8467 - DNA, 17 bp, Artificial sequence
  Synthesized sequence
tgtgcccgatttttgcc

SEQ ID NO: 8468 - DNA, 17 bp, Artificial sequence
  Synthesized sequence
caggcgttccggttgcg

SEQ ID NO: 8469 - DNA, 17 bp, Artificial sequence
  Synthesized sequence
gtggatcggcgtgcgct

SEQ ID NO: 8470 - DNA, 17 bp, Artificial sequence
  Synthesized sequence
ttggctaaactgcagct

SEQ ID NO: 8471 - DNA, 17 bp, Artificial sequence
  Synthesized sequence
cttgcgtgcccactgca

SEQ ID NO: 8472 - DNA, 17 bp, Artificial sequence
  Synthesized sequence
ctggtcgccctgctgct

SEQ ID NO: 8473 - DNA, 17 bp, Artificial sequence
  Synthesized sequence
ctggcgtggtcttcgaa

SEQ ID NO: 8474 - DNA, 17 bp, Artificial sequence
  Synthesized sequence
gtggccctgacgcttca

SEQ ID NO: 8475 - DNA, 17 bp, Artificial sequence
  Synthesized sequence
ctgggaatcgccttcca

SEQ ID NO: 8476 - DNA, 17 bp, Artificial sequence
  Synthesized sequence
ctggtggacgacctgct

SEQ ID NO: 8477 - DNA, 17 bp, Artificial sequence
  Synthesized sequence
ctggccgccctttttcg

SEQ ID NO: 8478 - DNA, 17 bp, Artificial sequence
  Synthesized sequence
gtggcgcgaggctgggg

SEQ ID NO: 8479 - DNA, 17 bp, Artificial sequence
  Synthesized sequence
ctggtggaagtgctgca

SEQ ID NO: 8480 - DNA, 17 bp, Artificial sequence
  Synthesized sequence
ttggcagcgcgaccgcg

SEQ ID NO: 8481 - DNA, 17 bp, Artificial sequence
  Synthesized sequence
ttcgctcggcgctggcg

SEQ ID NO: 8482 - DNA, 17 bp, Artificial sequence
  Synthesized sequence
gaggccagttttctgca

SEQ ID NO: 8483 - DNA, 17 bp, Artificial sequence
  Synthesized sequence
atggcacggaccgatcc

SEQ ID NO: 8484 - DNA, 17 bp, Artificial sequence
  Synthesized sequence
gtggcccgcgtcttttc

SEQ ID NO: 8485 - DNA, 17 bp, Artificial sequence
  Synthesized sequence
gcgccacactcggtgca

SEQ ID NO: 8486 - DNA, 17 bp, Artificial sequence
  Synthesized sequence
gcggtggaacaattgct

SEQ ID NO: 8487 - DNA, 17 bp, Artificial sequence
  Synthesized sequence
ctggaaggccccatgga

SEQ ID NO: 8488 - DNA, 17 bp, Artificial sequence
  Synthesized sequence
gctgaacatgtattgct

SEQ ID NO: 8489 - DNA, 17 bp, Artificial sequence
  Synthesized sequence
ctggatcgacttgagct

SEQ ID NO: 8490 - DNA, 17 bp, Artificial sequence
  Synthesized sequence
tcggcgaggcagtggca

SEQ ID NO: 8491 - DNA, 17 bp, Artificial sequence
  Synthesized sequence
aaggcagcgccgatgcg

SEQ ID NO: 8492 - DNA, 17 bp, Artificial sequence
  Synthesized sequence
ccggcacagaccacgcc

SEQ ID NO: 8493 - DNA, 17 bp, Artificial sequence
  Synthesized sequence
ctgccgccggggctgct

SEQ ID NO: 8494 - DNA, 17 bp, Artificial sequence
  Synthesized sequence
atgaccctgaaactgca

SEQ ID NO: 8495 - DNA, 17 bp, Artificial sequence
  Synthesized sequence
atgtccggattgctgct

SEQ ID NO: 8496 - DNA, 17 bp, Artificial sequence
  Synthesized sequence
ctgcaacccttgctgca

SEQ ID NO: 8497 - DNA, 17 bp, Artificial sequence
  Synthesized sequence
ctggtcggtagcctgca

SEQ ID NO: 8498 - DNA, 17 bp, Artificial sequence
  Synthesized sequence
atgtcgaagcggttgcg

SEQ ID NO: 8499 - DNA, 17 bp, Artificial sequence
  Synthesized sequence
ccggcggggcctttgaa

SEQ ID NO: 8500 - DNA, 17 bp, Artificial sequence
  Synthesized sequence
atggccaaggtcgagct

SEQ ID NO: 8501 - DNA, 17 bp, Artificial sequence
  Synthesized sequence
ttggcatcggccatccg

SEQ ID NO: 8502 - DNA, 17 bp, Artificial sequence
  Synthesized sequence
ttcgccctcggcgtgct

SEQ ID NO: 8503 - DNA, 17 bp, Artificial sequence
  Synthesized sequence
ttgagacgggtctttcg

SEQ ID NO: 8504 - DNA, 17 bp, Artificial sequence
  Synthesized sequence
ctcgaacacctgatgcg

SEQ ID NO: 8505 - DNA, 17 bp, Artificial sequence
  Synthesized sequence
gtggcagcgagcccgcc

SEQ ID NO: 8506 - DNA, 17 bp, Artificial sequence
  Synthesized sequence
gagggccgggttctgca

SEQ ID NO: 8507 - DNA, 17 bp, Artificial sequence
  Synthesized sequence
tcgacccaatggttgca

SEQ ID NO: 8508 - DNA, 17 bp, Artificial sequence
  Synthesized sequence
ctggaacgagctgtccc

SEQ ID NO: 8509 - DNA, 17 bp, Artificial sequence
  Synthesized sequence
aaggccgaactggtgct

SEQ ID NO: 8510 - DNA, 17 bp, Artificial sequence
  Synthesized sequence
gtggctggacgactggt

SEQ ID NO: 8511 - DNA, 17 bp, Artificial sequence
  Synthesized sequence
gtagcgcaccagttcct

SEQ ID NO: 8512 - DNA, 17 bp, Artificial sequence
  Synthesized sequence
gtggcagcccgatacct

SEQ ID NO: 8513 - DNA, 17 bp, Artificial sequence
  Synthesized sequence
tcgggattgcccatgct

SEQ ID NO: 8514 - DNA, 17 bp, Artificial sequence
  Synthesized sequence
ctgacccgcgccctgcg

SEQ ID NO: 8515 - DNA, 17 bp, Artificial sequence
  Synthesized sequence
ctggaaccggtgtgcct

SEQ ID NO: 8516 - DNA, 17 bp, Artificial sequence
  Synthesized sequence
taggccgggctttttca

SEQ ID NO: 8517 - DNA, 17 bp, Artificial sequence
  Synthesized sequence
ctacaacaggaattgct

SEQ ID NO: 8518 - DNA, 17 bp, Artificial sequence
  Synthesized sequence
tgggccggatcgatgct

SEQ ID NO: 8519 - DNA, 17 bp, Artificial sequence
  Synthesized sequence
gcggcgcgcacgtcgcg

SEQ ID NO: 8520 - DNA, 17 bp, Artificial sequence
  Synthesized sequence
ttcgcccattttttgtt

SEQ ID NO: 8521 - DNA, 17 bp, Artificial sequence
  Synthesized sequence
gtgttggagcttttgct

SEQ ID NO: 8522 - DNA, 17 bp, Artificial sequence
  Synthesized sequence
ttggtccgggtgatggt

SEQ ID NO: 8523 - DNA, 17 bp, Artificial sequence
  Synthesized sequence
gcggccagaccctggca

SEQ ID NO: 8524 - DNA, 17 bp, Artificial sequence
  Synthesized sequence
ctggcagggtggttcgg

SEQ ID NO: 8525 - DNA, 17 bp, Artificial sequence
  Synthesized sequence
aaggccgagccgatgct

SEQ ID NO: 8526 - DNA, 17 bp, Artificial sequence
  Synthesized sequence
ccggccagcgaagtgct

SEQ ID NO: 8527 - DNA, 17 bp, Artificial sequence
  Synthesized sequence
ccggcgtacgttctgca

SEQ ID NO: 8528 - DNA, 17 bp, Artificial sequence
  Synthesized sequence
ttcgccttgtatttgcc

SEQ ID NO: 8529 - DNA, 17 bp, Artificial sequence
  Synthesized sequence
gtggtgaagcgctggct

SEQ ID NO: 8530 - DNA, 17 bp, Artificial sequence
  Synthesized sequence
tcggcgcgcatcaggct

SEQ ID NO: 8531 - DNA, 17 bp, Artificial sequence
  Synthesized sequence
ctggatcgcctcgcgca

SEQ ID NO: 8532 - DNA, 17 bp, Artificial sequence
  Synthesized sequence
ttgttgccaggcttgca

SEQ ID NO: 8533 - DNA, 17 bp, Artificial sequence
  Synthesized sequence
ggggtgcgcaacctgct

SEQ ID NO: 8534 - DNA, 17 bp, Artificial sequence
  Synthesized sequence
gtggaccgggtgacgca

SEQ ID NO: 8535 - DNA, 17 bp, Artificial sequence
  Synthesized sequence
acggcccggcccaggct

SEQ ID NO: 8536 - DNA, 17 bp, Artificial sequence
  Synthesized sequence
ctgctgcgcctgctgct

SEQ ID NO: 8537 - DNA, 17 bp, Artificial sequence
  Synthesized sequence
atcgagctgtcgttgca

SEQ ID NO: 8538 - DNA, 17 bp, Artificial sequence
  Synthesized sequence
ccggcaacaaccatgcg

SEQ ID NO: 8539 - DNA, 17 bp, Artificial sequence
  Synthesized sequence
tcggctcgatcatcgcc

SEQ ID NO: 8540 - DNA, 17 bp, Artificial sequence
  Synthesized sequence
ctggcgctggtgtacct

SEQ ID NO: 8541 - DNA, 17 bp, Artificial sequence
  Synthesized sequence
atggaaagaaaagtgtt

SEQ ID NO: 8542 - DNA, 17 bp, Artificial sequence
  Synthesized sequence
ctggtggagatcttcca

SEQ ID NO: 8543 - DNA, 17 bp, Artificial sequence
  Synthesized sequence
ccggcgctgagcttgga

SEQ ID NO: 8544 - DNA, 17 bp, Artificial sequence
  Synthesized sequence
ttcgaaggcgggttgcg

SEQ ID NO: 8545 - DNA, 17 bp, Artificial sequence
  Synthesized sequence
gtcgccgaccagttgcg

SEQ ID NO: 8546 - DNA, 17 bp, Artificial sequence
  Synthesized sequence
ggcgcacgccccgtgcc

SEQ ID NO: 8547 - DNA, 17 bp, Artificial sequence
  Synthesized sequence
ctggccggcatctgcct

SEQ ID NO: 8548 - DNA, 17 bp, Artificial sequence
  Synthesized sequence
ctggccagcgccgcgct

SEQ ID NO: 8549 - DNA, 17 bp, Artificial sequence
  Synthesized sequence
atggcactacgtgcgaa

SEQ ID NO: 8550 - DNA, 17 bp, Artificial sequence
  Synthesized sequence
ctggaccaagcactgcc

SEQ ID NO: 8551 - DNA, 17 bp, Artificial sequence
  Synthesized sequence
ctggtgcatactgtgcg

SEQ ID NO: 8552 - DNA, 17 bp, Artificial sequence
  Synthesized sequence
ctggtaggcgtgcggca

SEQ ID NO: 8553 - DNA, 17 bp, Artificial sequence
  Synthesized sequence
tcgggagcgaccttgcg

SEQ ID NO: 8554 - DNA, 17 bp, Artificial sequence
  Synthesized sequence
tcgggagcgaccttgcg

SEQ ID NO: 8555 - DNA, 17 bp, Artificial sequence
  Synthesized sequence
ctggtggtgcacatgct

SEQ ID NO: 8556 - DNA, 17 bp, Artificial sequence
  Synthesized sequence
ccggcgcgatccttccc

SEQ ID NO: 8557 - DNA, 17 bp, Artificial sequence
  Synthesized sequence
cgggcactttctttccc

SEQ ID NO: 8558 - DNA, 17 bp, Artificial sequence
  Synthesized sequence
atagcccgaccttggcg

SEQ ID NO: 8559 - DNA, 17 bp, Artificial sequence
  Synthesized sequence
gttgcaggaaaattacg

SEQ ID NO: 8560 - DNA, 17 bp, Artificial sequence
  Synthesized sequence
gcggccgggctgttcca

SEQ ID NO: 8561 - DNA, 17 bp, Artificial sequence
  Synthesized sequence
ctggaacaggaagcgcc

SEQ ID NO: 8562 - DNA, 17 bp, Artificial sequence
  Synthesized sequence
agggcgacgccattgcc

SEQ ID NO: 8563 - DNA, 17 bp, Artificial sequence
  Synthesized sequence
ctgtcgcacctgctgcg

SEQ ID NO: 8564 - DNA, 17 bp, Artificial sequence
  Synthesized sequence
tggggatgacatttgga

SEQ ID NO: 8565 - DNA, 17 bp, Artificial sequence
  Synthesized sequence
atgacgcgcttctttcg

SEQ ID NO: 8566 - DNA, 17 bp, Artificial sequence
  Synthesized sequence
ctgggcgaagtggtgct

SEQ ID NO: 8567 - DNA, 17 bp, Artificial sequence
  Synthesized sequence
ctggtatgcggactggt

SEQ ID NO: 8568 - DNA, 17 bp, Artificial sequence
  Synthesized sequence
ccggcatagtgcccgct

SEQ ID NO: 8569 - DNA, 17 bp, Artificial sequence
  Synthesized sequence
tcggcaccgacatcgat

SEQ ID NO: 8570 - DNA, 17 bp, Artificial sequence
  Synthesized sequence
tcggctcgggcatcgcc

SEQ ID NO: 8571 - DNA, 17 bp, Artificial sequence
  Synthesized sequence
ctggcgcaaccggggcc

SEQ ID NO: 8572 - DNA, 17 bp, Artificial sequence
  Synthesized sequence
gtggtgagctacttcct

SEQ ID NO: 8573 - DNA, 17 bp, Artificial sequence
  Synthesized sequence
caggccgtgcagttgcc

SEQ ID NO: 8574 - DNA, 17 bp, Artificial sequence
  Synthesized sequence
gtggcgcttgtagcgca

SEQ ID NO: 8575 - DNA, 17 bp, Artificial sequence
  Synthesized sequence
ctggtgctgttggtgcc

SEQ ID NO: 8576 - DNA, 17 bp, Artificial sequence
  Synthesized sequence
ctggcgctcggtgcgct

SEQ ID NO: 8577 - DNA, 17 bp, Artificial sequence
  Synthesized sequence
aaggccctcgaggtgca

SEQ ID NO: 8578 - DNA, 17 bp, Artificial sequence
  Synthesized sequence
gcgggccttcagttgca

SEQ ID NO: 8579 - DNA, 17 bp, Artificial sequence
  Synthesized sequence
gaggcccacggcctgcg

SEQ ID NO: 8580 - DNA, 17 bp, Artificial sequence
  Synthesized sequence
ctggaggggcatttcca

SEQ ID NO: 8581 - DNA, 17 bp, Artificial sequence
  Synthesized sequence
gtagcaaaagccctgcg

SEQ ID NO: 8582 - DNA, 17 bp, Artificial sequence
  Synthesized sequence
gtggcgggtctgctgtt

SEQ ID NO: 8583 - DNA, 17 bp, Artificial sequence
  Synthesized sequence
ctggaaaaccagttggc

SEQ ID NO: 8584 - DNA, 17 bp, Artificial sequence
  Synthesized sequence
gtgaaacaggcattcct

SEQ ID NO: 8585 - DNA, 17 bp, Artificial sequence
  Synthesized sequence
gtggcgacgccgtcgcg

SEQ ID NO: 8586 - DNA, 17 bp, Artificial sequence
  Synthesized sequence
gtcgatgggcagttgct

SEQ ID NO: 8587 - DNA, 17 bp, Artificial sequence
  Synthesized sequence
atcgccgggccgatgct

SEQ ID NO: 8588 - DNA, 17 bp, Artificial sequence
  Synthesized sequence
gtagctcaccgatggct

SEQ ID NO: 8589 - DNA, 17 bp, Artificial sequence
  Synthesized sequence
ctgctaccgcgcttcct

SEQ ID NO: 8590 - DNA, 17 bp, Artificial sequence
  Synthesized sequence
ctggaaagcccgctgtt

SEQ ID NO: 8591 - DNA, 17 bp, Artificial sequence
  Synthesized sequence
tcggcccagtacttggg

SEQ ID NO: 8592 - DNA, 17 bp, Artificial sequence
  Synthesized sequence
tgggcctgtacctggct

SEQ ID NO: 8593 - DNA, 17 bp, Artificial sequence
  Synthesized sequence
ttgcttcgccggttgcc

SEQ ID NO: 8594 - DNA, 17 bp, Artificial sequence
  Synthesized sequence
acggcaagcccgccgct

SEQ ID NO: 8595 - DNA, 17 bp, Artificial sequence
  Synthesized sequence
aaggccggcaaggtgca

SEQ ID NO: 8596 - DNA, 17 bp, Artificial sequence
  Synthesized sequence
tcgacttgggtgttgca

SEQ ID NO: 8597 - DNA, 17 bp, Artificial sequence
  Synthesized sequence
gcgcaacacactttgca

SEQ ID NO: 8598 - DNA, 17 bp, Artificial sequence
  Synthesized sequence
ctgccgcgtgccttgaa

SEQ ID NO: 8599 - DNA, 17 bp, Artificial sequence
  Synthesized sequence
ctgccgcgtgccttgaa

SEQ ID NO: 8600 - DNA, 17 bp, Artificial sequence
  Synthesized sequence
gtgggcggcgcgctgca

SEQ ID NO: 8601 - DNA, 17 bp, Artificial sequence
  Synthesized sequence
ctggctggtggatggcg

SEQ ID NO: 8602 - DNA, 17 bp, Artificial sequence
  Synthesized sequence
ctggtgggcaccttcct

SEQ ID NO: 8603 - DNA, 17 bp, Artificial sequence
  Synthesized sequence
atggcgtgctggctgat

SEQ ID NO: 8604 - DNA, 17 bp, Artificial sequence
  Synthesized sequence
ctggtggatctcctgca

SEQ ID NO: 8605 - DNA, 17 bp, Artificial sequence
  Synthesized sequence
caggccgacctgctgct

SEQ ID NO: 8606 - DNA, 17 bp, Artificial sequence
  Synthesized sequence
cttgcatcagtagtgcc

SEQ ID NO: 8607 - DNA, 17 bp, Artificial sequence
  Synthesized sequence
ctgccgcgcggtttcca

SEQ ID NO: 8608 - DNA, 17 bp, Artificial sequence
  Synthesized sequence
ctggccagcagccggca

SEQ ID NO: 8609 - DNA, 17 bp, Artificial sequence
  Synthesized sequence
ctggagcgcctggcgca

SEQ ID NO: 8610 - DNA, 17 bp, Artificial sequence
  Synthesized sequence
atcgccctgcagtggct

SEQ ID NO: 8611 - DNA, 17 bp, Artificial sequence
  Synthesized sequence
ctggcgaggcgctcggt

SEQ ID NO: 8612 - DNA, 17 bp, Artificial sequence
  Synthesized sequence
ctggcggggcgactgga

SEQ ID NO: 8613 - DNA, 17 bp, Artificial sequence
  Synthesized sequence
aagccactgccgctgct

SEQ ID NO: 8614 - DNA, 17 bp, Artificial sequence
  Synthesized sequence
ctggtccggactcggca

SEQ ID NO: 8615 - DNA, 17 bp, Artificial sequence
  Synthesized sequence
taggcgctgcccatgcg

SEQ ID NO: 8616 - DNA, 17 bp, Artificial sequence
  Synthesized sequence
atgggactggatgagca

SEQ ID NO: 8617 - DNA, 17 bp, Artificial sequence
  Synthesized sequence
atggagaatatcgtgct

SEQ ID NO: 8618 - DNA, 17 bp, Artificial sequence
  Synthesized sequence
tggggaggcgtgatgct

SEQ ID NO: 8619 - DNA, 17 bp, Artificial sequence
  Synthesized sequence
tgtgcgcggctcatgct

SEQ ID NO: 8620 - DNA, 17 bp, Artificial sequence
  Synthesized sequence
ctggcacgacctggccg

SEQ ID NO: 8621 - DNA, 17 bp, Artificial sequence
  Synthesized sequence
ctgcccaaggcgttgcg

SEQ ID NO: 8622 - DNA, 17 bp, Artificial sequence
  Synthesized sequence
ttggccggaagcctact

SEQ ID NO: 8623 - DNA, 17 bp, Artificial sequence
  Synthesized sequence
ctggcactgccgcggaa

SEQ ID NO: 8624 - DNA, 17 bp, Artificial sequence
  Synthesized sequence
atgccacgctcgtctct

SEQ ID NO: 8625 - DNA, 17 bp, Artificial sequence
  Synthesized sequence
tcggcagcggtctcgcc

SEQ ID NO: 8626 - DNA, 17 bp, Artificial sequence
  Synthesized sequence
ctgcgacggtcgatgcc

SEQ ID NO: 8627 - DNA, 17 bp, Artificial sequence
  Synthesized sequence
agggcccggacttttcc

SEQ ID NO: 8628 - DNA, 17 bp, Artificial sequence
  Synthesized sequence
atggtgcggctgtcgat

SEQ ID NO: 8629 - DNA, 17 bp, Artificial sequence
  Synthesized sequence
ctggcgctgtccttcat

SEQ ID NO: 8630 - DNA, 17 bp, Artificial sequence
  Synthesized sequence
ctgccgctgcattggct

SEQ ID NO: 8631 - DNA, 17 bp, Artificial sequence
  Synthesized sequence
ttgtgaggccttgtgca

SEQ ID NO: 8632 - DNA, 17 bp, Artificial sequence
  Synthesized sequence
cgggaaccgtgatggca

SEQ ID NO: 8633 - DNA, 17 bp, Artificial sequence
  Synthesized sequence
agggaattggtcgtgct

SEQ ID NO: 8634 - DNA, 17 bp, Artificial sequence
  Synthesized sequence
tgtgaacagcttttgcc

SEQ ID NO: 8635 - DNA, 17 bp, Artificial sequence
  Synthesized sequence
gtggaactgctcgggcc

SEQ ID NO: 8636 - DNA, 17 bp, Artificial sequence
  Synthesized sequence
accgcaccctacctgct

SEQ ID NO: 8637 - DNA, 17 bp, Artificial sequence
  Synthesized sequence
gcggcacacggcatcca

SEQ ID NO: 8638 - DNA, 17 bp, Artificial sequence
  Synthesized sequence
atggctggccgaacgct

SEQ ID NO: 8639 - DNA, 17 bp, Artificial sequence
  Synthesized sequence
cgggcacatccagagca

SEQ ID NO: 8640 - DNA, 17 bp, Artificial sequence
  Synthesized sequence
tccgcacgccgatttca

SEQ ID NO: 8641 - DNA, 17 bp, Artificial sequence
  Synthesized sequence
ctggctcaacctcggcc

SEQ ID NO: 8642 - DNA, 17 bp, Artificial sequence
  Synthesized sequence
ctggcccgcgcgctggc

SEQ ID NO: 8643 - DNA, 17 bp, Artificial sequence
  Synthesized sequence
gtggcgctgaactacct

SEQ ID NO: 8644 - DNA, 17 bp, Artificial sequence
  Synthesized sequence
tcggcccgctgctggcc

SEQ ID NO: 8645 - DNA, 17 bp, Artificial sequence
  Synthesized sequence
aaggcgccggcgttggt

SEQ ID NO: 8646 - DNA, 17 bp, Artificial sequence
  Synthesized sequence
gtagcgatttccttgca

SEQ ID NO: 8647 - DNA, 17 bp, Artificial sequence
  Synthesized sequence
acggcgagcacgctgct

SEQ ID NO: 8648 - DNA, 17 bp, Artificial sequence
  Synthesized sequence
gtggcgccggactacct

SEQ ID NO: 8649 - DNA, 17 bp, Artificial sequence
  Synthesized sequence
atggcaatgccagcgcg

SEQ ID NO: 8650 - DNA, 17 bp, Artificial sequence
  Synthesized sequence
ctcgctcgtcgatggca

SEQ ID NO: 8651 - DNA, 17 bp, Artificial sequence
  Synthesized sequence
ccggcgcgggttccgct

SEQ ID NO: 8652 - DNA, 17 bp, Artificial sequence
  Synthesized sequence
tcgacacgcctttcgcc

SEQ ID NO: 8653 - DNA, 17 bp, Artificial sequence
  Synthesized sequence
ccggcgcaggccgtgcc

SEQ ID NO: 8654 - DNA, 17 bp, Artificial sequence
  Synthesized sequence
ttgtgaggcaggttgcc

SEQ ID NO: 8655 - DNA, 17 bp, Artificial sequence
  Synthesized sequence
atgggccggcccatgga

SEQ ID NO: 8656 - DNA, 17 bp, Artificial sequence
  Synthesized sequence
ctggccgccgccctgcc

SEQ ID NO: 8657 - DNA, 17 bp, Artificial sequence
  Synthesized sequence
ccggcgcacctctagcc

SEQ ID NO: 8658 - DNA, 17 bp, Artificial sequence
  Synthesized sequence
acggcccgggcattccg

SEQ ID NO: 8659 - DNA, 17 bp, Artificial sequence
  Synthesized sequence
ctggcacgcaaggcggg

SEQ ID NO: 8660 - DNA, 17 bp, Artificial sequence
  Synthesized sequence
tagtcagggctttcgct

SEQ ID NO: 8661 - DNA, 17 bp, Artificial sequence
  Synthesized sequence
gtggcagcgcctcggcg

SEQ ID NO: 8662 - DNA, 17 bp, Artificial sequence
  Synthesized sequence
ggggaaacgcctttgcc

SEQ ID NO: 8663 - DNA, 17 bp, Artificial sequence
  Synthesized sequence
accgcatggcactggca

SEQ ID NO: 8664 - DNA, 17 bp, Artificial sequence
  Synthesized sequence
ggggcacgggcactacg

SEQ ID NO: 8665 - DNA, 17 bp, Artificial sequence
  Synthesized sequence
gagggccggaccatgct

SEQ ID NO: 8666 - DNA, 17 bp, Artificial sequence
  Synthesized sequence
ctgccgcagatctggcg

SEQ ID NO: 8667 - DNA, 17 bp, Artificial sequence
  Synthesized sequence
gtcgccctgcacttcct

SEQ ID NO: 8668 - DNA, 17 bp, Artificial sequence
  Synthesized sequence
ctgatacgggtgttccg

SEQ ID NO: 8669 - DNA, 17 bp, Artificial sequence
  Synthesized sequence
ctggctataatgtcgcc

SEQ ID NO: 8670 - DNA, 17 bp, Artificial sequence
  Synthesized sequence
ttcgcctaccacgtgct

SEQ ID NO: 8671 - DNA, 17 bp, Artificial sequence
  Synthesized sequence
ctggctggataccggca

SEQ ID NO: 8672 - DNA, 17 bp, Artificial sequence
  Synthesized sequence
gtggccgtcgacctgcg

SEQ ID NO: 8673 - DNA, 17 bp, Artificial sequence
  Synthesized sequence
ccggcatcgccgtggcc

SEQ ID NO: 8674 - DNA, 17 bp, Artificial sequence
  Synthesized sequence
cgggccaagttcatgca

SEQ ID NO: 8675 - DNA, 17 bp, Artificial sequence
  Synthesized sequence
ctgccgctaggcctgct

SEQ ID NO: 8676 - DNA, 17 bp, Artificial sequence
  Synthesized sequence
gtagtaccgccttcgca

SEQ ID NO: 8677 - DNA, 17 bp, Artificial sequence
  Synthesized sequence
gtggccagcgaggcgct

SEQ ID NO: 8678 - DNA, 17 bp, Artificial sequence
  Synthesized sequence
ctggtccgccgcaagct

SEQ ID NO: 8679 - DNA, 17 bp, Artificial sequence
  Synthesized sequence
ctgctgcaacgcttgcg

SEQ ID NO: 8680 - DNA, 17 bp, Artificial sequence
  Synthesized sequence
aaggaaaagttctggct

SEQ ID NO: 8681 - DNA, 17 bp, Artificial sequence
  Synthesized sequence
gtcgtactatttttgaa

SEQ ID NO: 8682 - DNA, 17 bp, Artificial sequence
  Synthesized sequence
atcgcacgaccggcgcg

SEQ ID NO: 8683 - DNA, 17 bp, Artificial sequence
  Synthesized sequence
taggaaggaattttcct

SEQ ID NO: 8684 - DNA, 17 bp, Artificial sequence
  Synthesized sequence
atgggacagccactgag

SEQ ID NO: 8685 - DNA, 17 bp, Artificial sequence
  Synthesized sequence
caggcgccgctggtgcc

SEQ ID NO: 8686 - DNA, 17 bp, Artificial sequence
  Synthesized sequence
gccgctcacgctttgct

SEQ ID NO: 8687 - DNA, 17 bp, Artificial sequence
  Synthesized sequence
ctcgcacagcgcttttt

SEQ ID NO: 8688 - DNA, 17 bp, Artificial sequence
  Synthesized sequence
gtggcctatacttttcg

SEQ ID NO: 8689 - DNA, 17 bp, Artificial sequence
  Synthesized sequence
ctggaccgagtcgcgca

SEQ ID NO: 8690 - DNA, 17 bp, Artificial sequence
  Synthesized sequence
ctggtcgacgccctgct

SEQ ID NO: 8691 - DNA, 17 bp, Artificial sequence
  Synthesized sequence
ttggcaagcagctgccc

SEQ ID NO: 8692 - DNA, 17 bp, Artificial sequence
  Synthesized sequence
aaggcaccggcgcggct

SEQ ID NO: 8693 - DNA, 17 bp, Artificial sequence
  Synthesized sequence
ttggcgggagtgaagct

SEQ ID NO: 8694 - DNA, 17 bp, Artificial sequence
  Synthesized sequence
ctggtcgaccgggtgct

SEQ ID NO: 8695 - DNA, 17 bp, Artificial sequence
  Synthesized sequence
tgggcgtgattgttaca

SEQ ID NO: 8696 - DNA, 17 bp, Artificial sequence
  Synthesized sequence
gtggcctacctggtgta

SEQ ID NO: 8697 - DNA, 17 bp, Artificial sequence
  Synthesized sequence
gtgccgccggagctgct

SEQ ID NO: 8698 - DNA, 17 bp, Artificial sequence
  Synthesized sequence
ctggcgccgcacaagcg

SEQ ID NO: 8699 - DNA, 17 bp, Artificial sequence
  Synthesized sequence
ctgggccttcatttcct

SEQ ID NO: 8700 - DNA, 17 bp, Artificial sequence
  Synthesized sequence
caggcatccgcactgcg

SEQ ID NO: 8701 - DNA, 17 bp, Artificial sequence
  Synthesized sequence
ggcgcacgtcgcttgta

SEQ ID NO: 8702 - DNA, 17 bp, Artificial sequence
  Synthesized sequence
taggccgggcatttcct

SEQ ID NO: 8703 - DNA, 17 bp, Artificial sequence
  Synthesized sequence
agcgcgccggccttgct

SEQ ID NO: 8704 - DNA, 17 bp, Artificial sequence
  Synthesized sequence
atggcgcgcgaactggg

SEQ ID NO: 8705 - DNA, 17 bp, Artificial sequence
  Synthesized sequence
agtggacagggtttgca

SEQ ID NO: 8706 - DNA, 17 bp, Artificial sequence
  Synthesized sequence
ccggccggagagctgct

SEQ ID NO: 8707 - DNA, 17 bp, Artificial sequence
  Synthesized sequence
ccggcactttagtttcc

SEQ ID NO: 8708 - DNA, 17 bp, Artificial sequence
  Synthesized sequence
gtggcgtgggcgatgga

SEQ ID NO: 8709 - DNA, 17 bp, Artificial sequence
  Synthesized sequence
atgacccagggtttgaa

SEQ ID NO: 8710 - DNA, 17 bp, Artificial sequence
  Synthesized sequence
gtggtaccgcacctccg

SEQ ID NO: 8711 - DNA, 17 bp, Artificial sequence
  Synthesized sequence
aaggcctcgcccctgct

SEQ ID NO: 8712 - DNA, 17 bp, Artificial sequence
  Synthesized sequence
atggcgctggggatgat

SEQ ID NO: 8713 - DNA, 17 bp, Artificial sequence
  Synthesized sequence
caggccgagcatctgct

SEQ ID NO: 8714 - DNA, 17 bp, Artificial sequence
  Synthesized sequence
ttgccgcgacgctcgcg

SEQ ID NO: 8715 - DNA, 17 bp, Artificial sequence
  Synthesized sequence
ttgccgcgacgctcgcg

SEQ ID NO: 8716 - DNA, 17 bp, Artificial sequence
  Synthesized sequence
cttgcaggggaatggcc

SEQ ID NO: 8717 - DNA, 17 bp, Artificial sequence
  Synthesized sequence
gcgccgcggcggttgcc

SEQ ID NO: 8718 - DNA, 17 bp, Artificial sequence
  Synthesized sequence
ttcgccagccatctgct

SEQ ID NO: 8719 - DNA, 17 bp, Artificial sequence
  Synthesized sequence
aaggcccgcctcccgca

SEQ ID NO: 8720 - DNA, 17 bp, Artificial sequence
  Synthesized sequence
ctggccctgctgcggcc

SEQ ID NO: 8721 - DNA, 17 bp, Artificial sequence
  Synthesized sequence
ctgtccggaccgctgct

SEQ ID NO: 8722 - DNA, 17 bp, Artificial sequence
  Synthesized sequence
ctgcgccggttcctgct

SEQ ID NO: 8723 - DNA, 17 bp, Artificial sequence
  Synthesized sequence
ttgccgttatacttgcg

SEQ ID NO: 8724 - DNA, 17 bp, Artificial sequence
  Synthesized sequence
gccgcaccgttttcgca

SEQ ID NO: 8725 - DNA, 17 bp, Artificial sequence
  Synthesized sequence
ttggcggaaaatttccg

SEQ ID NO: 8726 - DNA, 17 bp, Artificial sequence
  Synthesized sequence
atggcgcagccgcggcc

SEQ ID NO: 8727 - DNA, 17 bp, Artificial sequence
  Synthesized sequence
gagggcttgctcttgca

SEQ ID NO: 8728 - DNA, 17 bp, Artificial sequence
  Synthesized sequence
ccggcgccctgctggct

SEQ ID NO: 8729 - DNA, 17 bp, Artificial sequence
  Synthesized sequence
ccggcgcgctgctggcg

SEQ ID NO: 8730 - DNA, 17 bp, Artificial sequence
  Synthesized sequence
gtggccctcgccgagca

SEQ ID NO: 8731 - DNA, 17 bp, Artificial sequence
  Synthesized sequence
agggcattcccctggcc

SEQ ID NO: 8732 - DNA, 17 bp, Artificial sequence
  Synthesized sequence
ttggtgtcattcatgca

SEQ ID NO: 8733 - DNA, 17 bp, Artificial sequence
  Synthesized sequence
gccgcatgaatttagct

SEQ ID NO: 8734 - DNA, 17 bp, Artificial sequence
  Synthesized sequence
gtcgaagtcggcttgca

SEQ ID NO: 8735 - DNA, 17 bp, Artificial sequence
  Synthesized sequence
ctggacttcctgatgca

SEQ ID NO: 8736 - DNA, 17 bp, Artificial sequence
  Synthesized sequence
cgcgcccgccagttgcg

SEQ ID NO: 8737 - DNA, 17 bp, Artificial sequence
  Synthesized sequence
cgcgcccgccagttgcg

SEQ ID NO: 8738 - DNA, 17 bp, Artificial sequence
  Synthesized sequence
gtcggacgatactggcg

SEQ ID NO: 8739 - DNA, 17 bp, Artificial sequence
  Synthesized sequence
atggatggccaatggct

SEQ ID NO: 8740 - DNA, 17 bp, Artificial sequence
  Synthesized sequence
ctgtcccagcgtctgcg

SEQ ID NO: 8741 - DNA, 17 bp, Artificial sequence
  Synthesized sequence
gtagtaggcccactgct

SEQ ID NO: 8742 - DNA, 17 bp, Artificial sequence
  Synthesized sequence
ctggaaaactgattgag

SEQ ID NO: 8743 - DNA, 17 bp, Artificial sequence
  Synthesized sequence
ttggcaaaacagtcggg

SEQ ID NO: 8744 - DNA, 17 bp, Artificial sequence
  Synthesized sequence
atgcgaccccgcctgca

SEQ ID NO: 8745 - DNA, 17 bp, Artificial sequence
  Synthesized sequence
tcgccacggccgctgcc

SEQ ID NO: 8746 - DNA, 17 bp, Artificial sequence
  Synthesized sequence
ccggcgcccacctcgca

SEQ ID NO: 8747 - DNA, 17 bp, Artificial sequence
  Synthesized sequence
ttgcgatcgagcttgcg

SEQ ID NO: 8748 - DNA, 17 bp, Artificial sequence
  Synthesized sequence
tcggcacgaccctggtc

SEQ ID NO: 8749 - DNA, 17 bp, Artificial sequence
  Synthesized sequence
cgggcacatgccgcgca

SEQ ID NO: 8750 - DNA, 17 bp, Artificial sequence
  Synthesized sequence
ctgcaactctccatgct

SEQ ID NO: 8751 - DNA, 17 bp, Artificial sequence
  Synthesized sequence
tcggcggtggccttgcg

SEQ ID NO: 8752 - DNA, 17 bp, Artificial sequence
  Synthesized sequence
gtcgaacagcgcctgcg

SEQ ID NO: 8753 - DNA, 17 bp, Artificial sequence
  Synthesized sequence
gtgtgactgagggtgct

SEQ ID NO: 8754 - DNA, 17 bp, Artificial sequence
  Synthesized sequence
gtggcgcaccacctggc

SEQ ID NO: 8755 - DNA, 17 bp, Artificial sequence
  Synthesized sequence
gggacacggccagtgcc

SEQ ID NO: 8756 - DNA, 17 bp, Artificial sequence
  Synthesized sequence
accgcgcggacgttgcg

SEQ ID NO: 8757 - DNA, 17 bp, Artificial sequence
  Synthesized sequence
ctggcgcgagcactacc

SEQ ID NO: 8758 - DNA, 17 bp, Artificial sequence
  Synthesized sequence
tgcgctcggcgcttgcc

SEQ ID NO: 8759 - DNA, 17 bp, Artificial sequence
  Synthesized sequence
ctggaagccctgtagcg

SEQ ID NO: 8760 - DNA, 17 bp, Artificial sequence
  Synthesized sequence
gaggcgctggcctggca

SEQ ID NO: 8761 - DNA, 17 bp, Artificial sequence
  Synthesized sequence
ctggtggaggccatgca

SEQ ID NO: 8762 - DNA, 17 bp, Artificial sequence
  Synthesized sequence
ccggcaccggcgaggca

SEQ ID NO: 8763 - DNA, 17 bp, Artificial sequence
  Synthesized sequence
ctggcgctgctgctgtg

SEQ ID NO: 8764 - DNA, 17 bp, Artificial sequence
  Synthesized sequence
gcggcattgctcgcgct

SEQ ID NO: 8765 - DNA, 17 bp, Artificial sequence
  Synthesized sequence
tcggcgcattcttggca

SEQ ID NO: 8766 - DNA, 17 bp, Artificial sequence
  Synthesized sequence
ctgggtcggcgcgcgct

SEQ ID NO: 8767 - DNA, 17 bp, Artificial sequence
  Synthesized sequence
tgggccaggacctggca

SEQ ID NO: 8768 - DNA, 17 bp, Artificial sequence
  Synthesized sequence
ctggcgcccgctgcgca

SEQ ID NO: 8769 - DNA, 17 bp, Artificial sequence
  Synthesized sequence
ctggaagcggcgctgcg

SEQ ID NO: 8770 - DNA, 17 bp, Artificial sequence
  Synthesized sequence
ctggaagcggcgctgcg

SEQ ID NO: 8771 - DNA, 17 bp, Artificial sequence
  Synthesized sequence
atggcaggcggctgccg

SEQ ID NO: 8772 - DNA, 17 bp, Artificial sequence
  Synthesized sequence
gtggcccaggtggtgac

SEQ ID NO: 8773 - DNA, 17 bp, Artificial sequence
  Synthesized sequence
cgggcatggcgaatcct

SEQ ID NO: 8774 - DNA, 17 bp, Artificial sequence
  Synthesized sequence
ctgccgctgggcctgct

SEQ ID NO: 8775 - DNA, 17 bp, Artificial sequence
  Synthesized sequence
atggccctgctgctggg

SEQ ID NO: 8776 - DNA, 17 bp, Artificial sequence
  Synthesized sequence
atggtgcgcggatagcg

SEQ ID NO: 8777 - DNA, 17 bp, Artificial sequence
  Synthesized sequence
tcggcaatgccctcgcg

SEQ ID NO: 8778 - DNA, 17 bp, Artificial sequence
  Synthesized sequence
gtggaccgcatcatgga

SEQ ID NO: 8779 - DNA, 17 bp, Artificial sequence
  Synthesized sequence
tgggcgcgatggtcgcc

SEQ ID NO: 8780 - DNA, 17 bp, Artificial sequence
  Synthesized sequence
tcggcactgcagtcggt

SEQ ID NO: 8781 - DNA, 17 bp, Artificial sequence
  Synthesized sequence
atggtcatggtcgtgct

SEQ ID NO: 8782 - DNA, 17 bp, Artificial sequence
  Synthesized sequence
ctggcgcgcgcacagcg

SEQ ID NO: 8783 - DNA, 17 bp, Artificial sequence
  Synthesized sequence
ctggcactgatctgctt

SEQ ID NO: 8784 - DNA, 17 bp, Artificial sequence
  Synthesized sequence
gtggaatccgcctcgcc

SEQ ID NO: 8785 - DNA, 17 bp, Artificial sequence
  Synthesized sequence
ctggcgctggtatctca

SEQ ID NO: 8786 - DNA, 17 bp, Artificial sequence
  Synthesized sequence
ctggccgagggcttccg

SEQ ID NO: 8787 - DNA, 17 bp, Artificial sequence
  Synthesized sequence
atcgctcatccagtgca

SEQ ID NO: 8788 - DNA, 17 bp, Artificial sequence
  Synthesized sequence
gtggccggtatccggca

SEQ ID NO: 8789 - DNA, 17 bp, Artificial sequence
  Synthesized sequence
aaggcgagggcgatgct

SEQ ID NO: 8790 - DNA, 17 bp, Artificial sequence
  Synthesized sequence
ccggcctggtgatcgca

SEQ ID NO: 8791 - DNA, 17 bp, Artificial sequence
  Synthesized sequence
atcgcagtgctctggcg

SEQ ID NO: 8792 - DNA, 17 bp, Artificial sequence
  Synthesized sequence
ctggcgtgtcggatggt

SEQ ID NO: 8793 - DNA, 17 bp, Artificial sequence
  Synthesized sequence
gcggaagaagtcctgct

SEQ ID NO: 8794 - DNA, 17 bp, Artificial sequence
  Synthesized sequence
gtggggcatggcttcca

SEQ ID NO: 8795 - DNA, 17 bp, Artificial sequence
  Synthesized sequence
ctggcgggtttcgtggt

SEQ ID NO: 8796 - DNA, 17 bp, Artificial sequence
  Synthesized sequence
gtggcagcaccaccgcg

SEQ ID NO: 8797 - DNA, 17 bp, Artificial sequence
  Synthesized sequence
ctgccgcgcgtctggcc

SEQ ID NO: 8798 - DNA, 17 bp, Artificial sequence
  Synthesized sequence
gcgtcacgccggctgcg

SEQ ID NO: 8799 - DNA, 17 bp, Artificial sequence
  Synthesized sequence
atcgcacagcagtggta

SEQ ID NO: 8800 - DNA, 17 bp, Artificial sequence
  Synthesized sequence
atgaaacgtactttcca

SEQ ID NO: 8801 - DNA, 17 bp, Artificial sequence
  Synthesized sequence
gaagcccagcaattgcg

SEQ ID NO: 8802 - DNA, 17 bp, Artificial sequence
  Synthesized sequence
tagccacgggcgatgcc

SEQ ID NO: 8803 - DNA, 17 bp, Artificial sequence
  Synthesized sequence
ctggcctgggattgcca

SEQ ID NO: 8804 - DNA, 17 bp, Artificial sequence
  Synthesized sequence
tcggtccattccttgcc

SEQ ID NO: 8805 - DNA, 17 bp, Artificial sequence
  Synthesized sequence
gaggtacagctcctgga

SEQ ID NO: 8806 - DNA, 17 bp, Artificial sequence
  Synthesized sequence
cgggccgaccatctgct

SEQ ID NO: 8807 - DNA, 17 bp, Artificial sequence
  Synthesized sequence
atggcttctactatgcc

SEQ ID NO: 8808 - DNA, 17 bp, Artificial sequence
  Synthesized sequence
ttagcagcggattttca

SEQ ID NO: 8809 - DNA, 17 bp, Artificial sequence
  Synthesized sequence
ctggcggaggaatttcc

SEQ ID NO: 8810 - DNA, 17 bp, Artificial sequence
  Synthesized sequence
agggcaacgtgctggcg

SEQ ID NO: 8811 - DNA, 17 bp, Artificial sequence
  Synthesized sequence
gtggaccagcttctcct

SEQ ID NO: 8812 - DNA, 17 bp, Artificial sequence
  Synthesized sequence
atggtgcgaccgctact

SEQ ID NO: 8813 - DNA, 17 bp, Artificial sequence
  Synthesized sequence
gcggcgtgcgtcctgcc

SEQ ID NO: 8814 - DNA, 17 bp, Artificial sequence
  Synthesized sequence
ctggaaggcggcgagca

SEQ ID NO: 8815 - DNA, 17 bp, Artificial sequence
  Synthesized sequence
gtggcggagcagaagct

SEQ ID NO: 8816 - DNA, 17 bp, Artificial sequence
  Synthesized sequence
ctggccggctacatcca

SEQ ID NO: 8817 - DNA, 17 bp, Artificial sequence
  Synthesized sequence
gtggcagtggccacgcc

SEQ ID NO: 8818 - DNA, 17 bp, Artificial sequence
  Synthesized sequence
cgggcagcgcattcgcc

SEQ ID NO: 8819 - DNA, 17 bp, Artificial sequence
  Synthesized sequence
ccagcgcggctgatgca

SEQ ID NO: 8820 - DNA, 17 bp, Artificial sequence
  Synthesized sequence
atggctcgtacggttcg

SEQ ID NO: 8821 - DNA, 17 bp, Artificial sequence
  Synthesized sequence
aagtcaggtcctttgcc

SEQ ID NO: 8822 - DNA, 17 bp, Artificial sequence
  Synthesized sequence
ttcgcacccgtgcggca

SEQ ID NO: 8823 - DNA, 17 bp, Artificial sequence
  Synthesized sequence
ttggaaagagccgtgaa

SEQ ID NO: 8824 - DNA, 17 bp, Artificial sequence
  Synthesized sequence
gaggtacatatgtcgcg

SEQ ID NO: 8825 - DNA, 17 bp, Artificial sequence
  Synthesized sequence
atggcacgcacaaggac

SEQ ID NO: 8826 - DNA, 17 bp, Artificial sequence
  Synthesized sequence
ccggaccgcacggtgct

SEQ ID NO: 8827 - DNA, 17 bp, Artificial sequence
  Synthesized sequence
gtggttggtggcgtgct

SEQ ID NO: 8828 - DNA, 17 bp, Artificial sequence
  Synthesized sequence
ctggaagccgaactgcc

SEQ ID NO: 8829 - DNA, 17 bp, Artificial sequence
  Synthesized sequence
atgggcggaacatagca

SEQ ID NO: 8830 - DNA, 17 bp, Artificial sequence
  Synthesized sequence
ctgatccgccatctgct

SEQ ID NO: 8831 - DNA, 17 bp, Artificial sequence
  Synthesized sequence
ctggagagcggcttcct

SEQ ID NO: 8832 - DNA, 17 bp, Artificial sequence
  Synthesized sequence
atggtccgccagctgga

SEQ ID NO: 8833 - DNA, 17 bp, Artificial sequence
  Synthesized sequence
agggcagcaacctggcg

SEQ ID NO: 8834 - DNA, 17 bp, Artificial sequence
  Synthesized sequence
gtggtccgcagcctggt

SEQ ID NO: 8835 - DNA, 17 bp, Artificial sequence
  Synthesized sequence
gtgctgcgcatcgtgca

SEQ ID NO: 8836 - DNA, 17 bp, Artificial sequence
  Synthesized sequence
aaggcctacggcgtgca

SEQ ID NO: 8837 - DNA, 17 bp, Artificial sequence
  Synthesized sequence
gtagcaatgccgctgcg

SEQ ID NO: 8838 - DNA, 17 bp, Artificial sequence
  Synthesized sequence
aaggcccagcacccgct

SEQ ID NO: 8839 - DNA, 17 bp, Artificial sequence
  Synthesized sequence
gcggagcgccgggtgct

SEQ ID NO: 8840 - DNA, 17 bp, Artificial sequence
  Synthesized sequence
gtggcagcgcgagggcc

SEQ ID NO: 8841 - DNA, 17 bp, Artificial sequence
  Synthesized sequence
gtgtcacgcatctcccc

SEQ ID NO: 8842 - DNA, 17 bp, Artificial sequence
  Synthesized sequence
ctggcgccgttggagcg

SEQ ID NO: 8843 - DNA, 17 bp, Artificial sequence
  Synthesized sequence
ctgcgacgcccgtcgcg

SEQ ID NO: 8844 - DNA, 17 bp, Artificial sequence
  Synthesized sequence
gtggaagtcacctggcg

SEQ ID NO: 8845 - DNA, 17 bp, Artificial sequence
  Synthesized sequence
atcggtccggcgttgct

SEQ ID NO: 8846 - DNA, 17 bp, Artificial sequence
  Synthesized sequence
ctggcaccgggcggcca

SEQ ID NO: 8847 - DNA, 17 bp, Artificial sequence
  Synthesized sequence
gtcgctctgcgtttgtt

SEQ ID NO: 8848 - DNA, 17 bp, Artificial sequence
  Synthesized sequence
aagccacgccgctcgcg

SEQ ID NO: 8849 - DNA, 17 bp, Artificial sequence
  Synthesized sequence
tcggcttactactggct

SEQ ID NO: 8850 - DNA, 17 bp, Artificial sequence
  Synthesized sequence
ctgccatggcgagtggt

SEQ ID NO: 8851 - DNA, 17 bp, Artificial sequence
  Synthesized sequence
acggcaggaaggacgct

SEQ ID NO: 8852 - DNA, 17 bp, Artificial sequence
  Synthesized sequence
acagccgggcgattgct

SEQ ID NO: 8853 - DNA, 17 bp, Artificial sequence
  Synthesized sequence
acagccgggcgattgct

SEQ ID NO: 8854 - DNA, 17 bp, Artificial sequence
  Synthesized sequence
gggccacggccctttcg

SEQ ID NO: 8855 - DNA, 17 bp, Artificial sequence
  Synthesized sequence
tgggcgcgcaggttgag

SEQ ID NO: 8856 - DNA, 17 bp, Artificial sequence
  Synthesized sequence
ttggaaggttccgcgca

SEQ ID NO: 8857 - DNA, 17 bp, Artificial sequence
  Synthesized sequence
cttgaatccgccttgcg

SEQ ID NO: 8858 - DNA, 17 bp, Artificial sequence
  Synthesized sequence
gtgccgcaggtctcgcc

SEQ ID NO: 8859 - DNA, 17 bp, Artificial sequence
  Synthesized sequence
ctgtccgggctgttcca

SEQ ID NO: 8860 - DNA, 17 bp, Artificial sequence
  Synthesized sequence
tttgcacggacgctggc

SEQ ID NO: 8861 - DNA, 17 bp, Artificial sequence
  Synthesized sequence
ccggcctggccggtgcc

SEQ ID NO: 8862 - DNA, 17 bp, Artificial sequence
  Synthesized sequence
gtgctccgcgtgctgct

SEQ ID NO: 8863 - DNA, 17 bp, Artificial sequence
  Synthesized sequence
aaggcccagttcccgct

SEQ ID NO: 8864 - DNA, 17 bp, Artificial sequence
  Synthesized sequence
gtggaaaaacatatgat

SEQ ID NO: 8865 - DNA, 17 bp, Artificial sequence
  Synthesized sequence
ccgccacctcgcctgct

SEQ ID NO: 8866 - DNA, 17 bp, Artificial sequence
  Synthesized sequence
gtggccggcggcgcgca

SEQ ID NO: 8867 - DNA, 17 bp, Artificial sequence
  Synthesized sequence
ggggtcaggtttttgcc

SEQ ID NO: 8868 - DNA, 17 bp, Artificial sequence
  Synthesized sequence
atcggcggcgtgttgct

SEQ ID NO: 8869 - DNA, 17 bp, Artificial sequence
  Synthesized sequence
ccggcgcggcagcggca

SEQ ID NO: 8870 - DNA, 17 bp, Artificial sequence
  Synthesized sequence
ctcgccagcgacgtgct

SEQ ID NO: 8871 - DNA, 17 bp, Artificial sequence
  Synthesized sequence
ctggagcgcctggagca

SEQ ID NO: 8872 - DNA, 17 bp, Artificial sequence
  Synthesized sequence
atggagtgcagcatgcg

SEQ ID NO: 8873 - DNA, 17 bp, Artificial sequence
  Synthesized sequence
tcggccccactttcgcg

SEQ ID NO: 8874 - DNA, 17 bp, Artificial sequence
  Synthesized sequence
ttggcagcacctgggcc

SEQ ID NO: 8875 - DNA, 17 bp, Artificial sequence
  Synthesized sequence
ctgtcatactgcttgtg

SEQ ID NO: 8876 - DNA, 17 bp, Artificial sequence
  Synthesized sequence
ccggcctgccaactgcg

SEQ ID NO: 8877 - DNA, 17 bp, Artificial sequence
  Synthesized sequence
gtggggcggcaaaggca

SEQ ID NO: 8878 - DNA, 17 bp, Artificial sequence
  Synthesized sequence
atgccccgtgccctgcg

SEQ ID NO: 8879 - DNA, 17 bp, Artificial sequence
  Synthesized sequence
caggccaaggccgtgca

SEQ ID NO: 8880 - DNA, 17 bp, Artificial sequence
  Synthesized sequence
ctcgcacgtcccacgcc

SEQ ID NO: 8881 - DNA, 17 bp, Artificial sequence
  Synthesized sequence
atgccaatcgagttgat

SEQ ID NO: 8882 - DNA, 17 bp, Artificial sequence
  Synthesized sequence
ctggccggcgccatcct

SEQ ID NO: 8883 - DNA, 17 bp, Artificial sequence
  Synthesized sequence
atggacatgcgcctgct

SEQ ID NO: 8884 - DNA, 17 bp, Artificial sequence
  Synthesized sequence
acggcacggcgcttcgc

SEQ ID NO: 8885 - DNA, 17 bp, Artificial sequence
  Synthesized sequence
gtggcggaagggtagcg

SEQ ID NO: 8886 - DNA, 17 bp, Artificial sequence
  Synthesized sequence
ctgccgcagctatggcg

SEQ ID NO: 8887 - DNA, 17 bp, Artificial sequence
  Synthesized sequence
cgggccggtcggctgct

SEQ ID NO: 8888 - DNA, 17 bp, Artificial sequence
  Synthesized sequence
ctggccggggcggtgga

SEQ ID NO: 8889 - DNA, 17 bp, Artificial sequence
  Synthesized sequence
ccggcgcgttcctcgcc

SEQ ID NO: 8890 - DNA, 17 bp, Artificial sequence
  Synthesized sequence
cgggtgcgccggctgct

SEQ ID NO: 8891 - DNA, 17 bp, Artificial sequence
  Synthesized sequence
gtcgcactgctgtctct

SEQ ID NO: 8892 - DNA, 17 bp, Artificial sequence
  Synthesized sequence
cctgcaacttgcttgca

SEQ ID NO: 8893 - DNA, 17 bp, Artificial sequence
  Synthesized sequence
ccgcgacgacgattgcc

SEQ ID NO: 8894 - DNA, 17 bp, Artificial sequence
  Synthesized sequence
atggccttcttcctgat

SEQ ID NO: 8895 - DNA, 17 bp, Artificial sequence
  Synthesized sequence
ctggggcgacatctgga

SEQ ID NO: 8896 - DNA, 17 bp, Artificial sequence
  Synthesized sequence
aaggcaggattctagaa

SEQ ID NO: 8897 - DNA, 17 bp, Artificial sequence
  Synthesized sequence
ctgctatcgatgctgct

SEQ ID NO: 8898 - DNA, 17 bp, Artificial sequence
  Synthesized sequence
atggcgcaagcgcggcg

SEQ ID NO: 8899 - DNA, 17 bp, Artificial sequence
  Synthesized sequence
tcggcaatctgcctgcg

SEQ ID NO: 8900 - DNA, 17 bp, Artificial sequence
  Synthesized sequence
tgcgcccagcccttgcg

SEQ ID NO: 8901 - DNA, 17 bp, Artificial sequence
  Synthesized sequence
ctcgaactggggctgca

SEQ ID NO: 8902 - DNA, 17 bp, Artificial sequence
  Synthesized sequence
ctggcagggcaaggact

SEQ ID NO: 8903 - DNA, 17 bp, Artificial sequence
  Synthesized sequence
aaggcctcgccgctgct

SEQ ID NO: 8904 - DNA, 17 bp, Artificial sequence
  Synthesized sequence
cccgcacgagtctttcg

SEQ ID NO: 8905 - DNA, 17 bp, Artificial sequence
  Synthesized sequence
gaggtagacccgctgct

SEQ ID NO: 8906 - DNA, 17 bp, Artificial sequence
  Synthesized sequence
atggtctggccgttgtc

SEQ ID NO: 8907 - DNA, 17 bp, Artificial sequence
  Synthesized sequence
gcggagcggtgctcgct

SEQ ID NO: 8908 - DNA, 17 bp, Artificial sequence
  Synthesized sequence
aaggcaggcttagtgtt

SEQ ID NO: 8909 - DNA, 17 bp, Artificial sequence
  Synthesized sequence
ctcgaaggcaccgtgca

SEQ ID NO: 8910 - DNA, 17 bp, Artificial sequence
  Synthesized sequence
aagggacgggttctgat

SEQ ID NO: 8911 - DNA, 17 bp, Artificial sequence
  Synthesized sequence
acgccagggttctcgca

SEQ ID NO: 8912 - DNA, 17 bp, Artificial sequence
  Synthesized sequence
ctggcgcggtttccact

SEQ ID NO: 8913 - DNA, 17 bp, Artificial sequence
  Synthesized sequence
agggctcgtggcgtgcc

SEQ ID NO: 8914 - DNA, 17 bp, Artificial sequence
  Synthesized sequence
ctggcagatgttctggc

SEQ ID NO: 8915 - DNA, 17 bp, Artificial sequence
  Synthesized sequence
ctggctgaccggtttcg

SEQ ID NO: 8916 - DNA, 17 bp, Artificial sequence
  Synthesized sequence
ctggcgcaaagcatggg

SEQ ID NO: 8917 - DNA, 17 bp, Artificial sequence
  Synthesized sequence
acggaagaagtgctgca

SEQ ID NO: 8918 - DNA, 17 bp, Artificial sequence
  Synthesized sequence
ctcggaattccattgca

SEQ ID NO: 8919 - DNA, 17 bp, Artificial sequence
  Synthesized sequence
ctgaccctgttcctgcg

SEQ ID NO: 8920 - DNA, 17 bp, Artificial sequence
  Synthesized sequence
ctggggctctacctgcc

SEQ ID NO: 8921 - DNA, 17 bp, Artificial sequence
  Synthesized sequence
ctggaaggccttccgcg

SEQ ID NO: 8922 - DNA, 17 bp, Artificial sequence
  Synthesized sequence
atcgccggctgcatgct

SEQ ID NO: 8923 - DNA, 17 bp, Artificial sequence
  Synthesized sequence
gtcgaccggcgcctgca

SEQ ID NO: 8924 - DNA, 17 bp, Artificial sequence
  Synthesized sequence
gtggaaatcgctgtgcc

SEQ ID NO: 8925 - DNA, 17 bp, Artificial sequence
  Synthesized sequence
ctgggcgccgagttgcg

SEQ ID NO: 8926 - DNA, 17 bp, Artificial sequence
  Synthesized sequence
ctggcggccagctcgcg

SEQ ID NO: 8927 - DNA, 17 bp, Artificial sequence
  Synthesized sequence
ctgtccggggcgatgct

SEQ ID NO: 8928 - DNA, 17 bp, Artificial sequence
  Synthesized sequence
ttggaaggcgtgctgga

SEQ ID NO: 8929 - DNA, 17 bp, Artificial sequence
  Synthesized sequence
aagggcaaggtgttgca

SEQ ID NO: 8930 - DNA, 17 bp, Artificial sequence
  Synthesized sequence
ggggcaagaccggagca

SEQ ID NO: 8931 - DNA, 17 bp, Artificial sequence
  Synthesized sequence
gttgcaggggcgtttcc

SEQ ID NO: 8932 - DNA, 17 bp, Artificial sequence
  Synthesized sequence
ctggtcatggccctgct

SEQ ID NO: 8933 - DNA, 17 bp, Artificial sequence
  Synthesized sequence
ctggccgatcatttccc

SEQ ID NO: 8934 - DNA, 17 bp, Artificial sequence
  Synthesized sequence
ctgccaggcttcctgat

SEQ ID NO: 8935 - DNA, 17 bp, Artificial sequence
  Synthesized sequence
ctggccggcgcggtgat

SEQ ID NO: 8936 - DNA, 17 bp, Artificial sequence
  Synthesized sequence
ctcgcctggggttggct

SEQ ID NO: 8937 - DNA, 17 bp, Artificial sequence
  Synthesized sequence
ttggcgccgccgccgcc

SEQ ID NO: 8938 - DNA, 17 bp, Artificial sequence
  Synthesized sequence
tcggcggcggggttgcg

SEQ ID NO: 8939 - DNA, 17 bp, Artificial sequence
  Synthesized sequence
cgggcgaccagcttgcc

SEQ ID NO: 8940 - DNA, 17 bp, Artificial sequence
  Synthesized sequence
ttggcctggagtccgcc

SEQ ID NO: 8941 - DNA, 17 bp, Artificial sequence
  Synthesized sequence
gttccatgtccgttgcc

SEQ ID NO: 8942 - DNA, 17 bp, Artificial sequence
  Synthesized sequence
ctggcaatgttcttcag

SEQ ID NO: 8943 - DNA, 17 bp, Artificial sequence
  Synthesized sequence
cggtcaaccggattgct

SEQ ID NO: 8944 - DNA, 17 bp, Artificial sequence
  Synthesized sequence
ctgggcggcctgatgcg

SEQ ID NO: 8945 - DNA, 17 bp, Artificial sequence
  Synthesized sequence
gcggcgctggggtggca

SEQ ID NO: 8946 - DNA, 17 bp, Artificial sequence
  Synthesized sequence
gtgtcaaacagcatgcc

SEQ ID NO: 8947 - DNA, 17 bp, Artificial sequence
  Synthesized sequence
cggccacgtcccgtgcc

SEQ ID NO: 8948 - DNA, 17 bp, Artificial sequence
  Synthesized sequence
caggagccgaccttgcg

SEQ ID NO: 8949 - DNA, 17 bp, Artificial sequence
  Synthesized sequence
ccagcacgacgctggcg

SEQ ID NO: 8950 - DNA, 17 bp, Artificial sequence
  Synthesized sequence
ctggcgccgaaccggcg

SEQ ID NO: 8951 - DNA, 17 bp, Artificial sequence
  Synthesized sequence
ctgcaaaggagactgct

SEQ ID NO: 8952 - DNA, 17 bp, Artificial sequence
  Synthesized sequence
ctggtgcgcaccctgga

SEQ ID NO: 8953 - DNA, 17 bp, Artificial sequence
  Synthesized sequence
ctggcgccctcctttgt

SEQ ID NO: 8954 - DNA, 17 bp, Artificial sequence
  Synthesized sequence
gtggccaagagcctggt

SEQ ID NO: 8955 - DNA, 17 bp, Artificial sequence
  Synthesized sequence
ctcgcccgcatccggct

SEQ ID NO: 8956 - DNA, 17 bp, Artificial sequence
  Synthesized sequence
ctgggcgaagctgtgct

SEQ ID NO: 8957 - DNA, 17 bp, Artificial sequence
  Synthesized sequence
agggcctgccccatgcc

SEQ ID NO: 8958 - DNA, 17 bp, Artificial sequence
  Synthesized sequence
aacgcccgggagttgcc

SEQ ID NO: 8959 - DNA, 17 bp, Artificial sequence
  Synthesized sequence
caggccggctttttcct

SEQ ID NO: 8960 - DNA, 17 bp, Artificial sequence
  Synthesized sequence
gccgcatggccgttgat

SEQ ID NO: 8961 - DNA, 17 bp, Artificial sequence
  Synthesized sequence
gccgcatggccgttgat

SEQ ID NO: 8962 - DNA, 17 bp, Artificial sequence
  Synthesized sequence
gccgcgcaggtgttgcg

SEQ ID NO: 8963 - DNA, 17 bp, Artificial sequence
  Synthesized sequence
ccggcacagccagtggc

SEQ ID NO: 8964 - DNA, 17 bp, Artificial sequence
  Synthesized sequence
atggtggtgccggtgct

SEQ ID NO: 8965 - DNA, 17 bp, Artificial sequence
  Synthesized sequence
gtggcccacgccctggg

SEQ ID NO: 8966 - DNA, 17 bp, Artificial sequence
  Synthesized sequence
ctggccgaccacccgca

SEQ ID NO: 8967 - DNA, 17 bp, Artificial sequence
  Synthesized sequence
tcggcatcctgctggcc

SEQ ID NO: 8968 - DNA, 17 bp, Artificial sequence
  Synthesized sequence
attgccctgctggtgcg

SEQ ID NO: 8969 - DNA, 17 bp, Artificial sequence
  Synthesized sequence
cgggcagccagcatgcg

SEQ ID NO: 8970 - DNA, 17 bp, Artificial sequence
  Synthesized sequence
tgggcgccgttggtgcg

SEQ ID NO: 8971 - DNA, 17 bp, Artificial sequence
  Synthesized sequence
cgcgccgggcatttgca

SEQ ID NO: 8972 - DNA, 17 bp, Artificial sequence
  Synthesized sequence
gcggcccggccgacgct

SEQ ID NO: 8973 - DNA, 17 bp, Artificial sequence
  Synthesized sequence
ctgggacccgcagggca

SEQ ID NO: 8974 - DNA, 17 bp, Artificial sequence
  Synthesized sequence
ttcgaacacggctttca

SEQ ID NO: 8975 - DNA, 17 bp, Artificial sequence
  Synthesized sequence
ttcgaacacggctttca

SEQ ID NO: 8976 - DNA, 17 bp, Artificial sequence
  Synthesized sequence
taggctcttaggatgct

SEQ ID NO: 8977 - DNA, 17 bp, Artificial sequence
  Synthesized sequence
gtggccctcataccgcc

SEQ ID NO: 8978 - DNA, 17 bp, Artificial sequence
  Synthesized sequence
gcggcctgcccgctgcg

SEQ ID NO: 8979 - DNA, 17 bp, Artificial sequence
  Synthesized sequence
ctggcgcacatctgccg

SEQ ID NO: 8980 - DNA, 17 bp, Artificial sequence
  Synthesized sequence
ttggaatagcgcttcat

SEQ ID NO: 8981 - DNA, 17 bp, Artificial sequence
  Synthesized sequence
tcggcctggcgctggcg

SEQ ID NO: 8982 - DNA, 17 bp, Artificial sequence
  Synthesized sequence
caggcaggccgccggca

SEQ ID NO: 8983 - DNA, 17 bp, Artificial sequence
  Synthesized sequence
ctgacacgaccgctccc

SEQ ID NO: 8984 - DNA, 17 bp, Artificial sequence
  Synthesized sequence
gcggtgccgacgttgcg

SEQ ID NO: 8985 - DNA, 17 bp, Artificial sequence
  Synthesized sequence
atggagcgactctgtca

SEQ ID NO: 8986 - DNA, 17 bp, Artificial sequence
  Synthesized sequence
atggcaatcaccctgac

SEQ ID NO: 8987 - DNA, 17 bp, Artificial sequence
  Synthesized sequence
gcggcatactacatgat

SEQ ID NO: 8988 - DNA, 17 bp, Artificial sequence
  Synthesized sequence
tgggcagcggtcttacc

SEQ ID NO: 8989 - DNA, 17 bp, Artificial sequence
  Synthesized sequence
atcggccgcctgatgct

SEQ ID NO: 8990 - DNA, 17 bp, Artificial sequence
  Synthesized sequence
gttccgcggcccttgcc

SEQ ID NO: 8991 - DNA, 17 bp, Artificial sequence
  Synthesized sequence
gtggcgatgaagtagcg

SEQ ID NO: 8992 - DNA, 17 bp, Artificial sequence
  Synthesized sequence
atggccactaccctgcc

SEQ ID NO: 8993 - DNA, 17 bp, Artificial sequence
  Synthesized sequence
tcggcaagggtttcggt

SEQ ID NO: 8994 - DNA, 17 bp, Artificial sequence
  Synthesized sequence
gttgcgcgacagttggc

SEQ ID NO: 8995 - DNA, 17 bp, Artificial sequence
  Synthesized sequence
gcggtgcgcgaggtgct

SEQ ID NO: 8996 - DNA, 17 bp, Artificial sequence
  Synthesized sequence
ctggcgccggtgttata

SEQ ID NO: 8997 - DNA, 17 bp, Artificial sequence
  Synthesized sequence
ctggcgccggtgttata

SEQ ID NO: 8998 - DNA, 17 bp, Artificial sequence
  Synthesized sequence
ctgaccctctgctggct

SEQ ID NO: 8999 - DNA, 17 bp, Artificial sequence
  Synthesized sequence
atggacaaccgctcgca

SEQ ID NO: 9000 - DNA, 17 bp, Artificial sequence
  Synthesized sequence
gtggccaagcaactggt

SEQ ID NO: 9001 - DNA, 17 bp, Artificial sequence
  Synthesized sequence
cagccagaactcctgct

SEQ ID NO: 9002 - DNA, 17 bp, Artificial sequence
  Synthesized sequence
atggcctggcccgtgtc

SEQ ID NO: 9003 - DNA, 17 bp, Artificial sequence
  Synthesized sequence
atcgcgtcgctcatgca

SEQ ID NO: 9004 - DNA, 17 bp, Artificial sequence
  Synthesized sequence
ttcgcgccctgctcgct

SEQ ID NO: 9005 - DNA, 17 bp, Artificial sequence
  Synthesized sequence
ctggatcaccagtcgcc

SEQ ID NO: 9006 - DNA, 17 bp, Artificial sequence
  Synthesized sequence
tcgccagccgccttgca

SEQ ID NO: 9007 - DNA, 17 bp, Artificial sequence
  Synthesized sequence
tcggcgcgcgcatcgcc

SEQ ID NO: 9008 - DNA, 17 bp, Artificial sequence
  Synthesized sequence
aaggcgccaattatgcg

SEQ ID NO: 9009 - DNA, 17 bp, Artificial sequence
  Synthesized sequence
gtgccgccgcagtggca

SEQ ID NO: 9010 - DNA, 17 bp, Artificial sequence
  Synthesized sequence
atgtcgctggacttgtt

SEQ ID NO: 9011 - DNA, 17 bp, Artificial sequence
  Synthesized sequence
ctggacttgttgtcgca

SEQ ID NO: 9012 - DNA, 17 bp, Artificial sequence
  Synthesized sequence
ctggccgagtttcttct

SEQ ID NO: 9013 - DNA, 17 bp, Artificial sequence
  Synthesized sequence
ttggcatccagggcgcc

SEQ ID NO: 9014 - DNA, 17 bp, Artificial sequence
  Synthesized sequence
cggacatggatgttcct

SEQ ID NO: 9015 - DNA, 17 bp, Artificial sequence
  Synthesized sequence
atggaactacgcctgag

SEQ ID NO: 9016 - DNA, 17 bp, Artificial sequence
  Synthesized sequence
tcggcctgggacatgcc

SEQ ID NO: 9017 - DNA, 17 bp, Artificial sequence
  Synthesized sequence
atggcaacagtcgtccc

SEQ ID NO: 9018 - DNA, 17 bp, Artificial sequence
  Synthesized sequence
ttcgcgctgtactttct

SEQ ID NO: 9019 - DNA, 17 bp, Artificial sequence
  Synthesized sequence
tcggccggaggaatgca

SEQ ID NO: 9020 - DNA, 17 bp, Artificial sequence
  Synthesized sequence
ttggcaaatacgaagcc

SEQ ID NO: 9021 - DNA, 17 bp, Artificial sequence
  Synthesized sequence
ttggcaaatacgaagcc

SEQ ID NO: 9022 - DNA, 17 bp, Artificial sequence
  Synthesized sequence
acgccactgatcttcca

SEQ ID NO: 9023 - DNA, 17 bp, Artificial sequence
  Synthesized sequence
ctgggtcggctctgcct

SEQ ID NO: 9024 - DNA, 17 bp, Artificial sequence
  Synthesized sequence
ctgtcaccgcgacggca

SEQ ID NO: 9025 - DNA, 17 bp, Artificial sequence
  Synthesized sequence
cgggccgatggcttgcg

SEQ ID NO: 9026 - DNA, 17 bp, Artificial sequence
  Synthesized sequence
aggtcacctgcattgcc

SEQ ID NO: 9027 - DNA, 17 bp, Artificial sequence
  Synthesized sequence
gtggctaccgcactgcg

SEQ ID NO: 9028 - DNA, 17 bp, Artificial sequence
  Synthesized sequence
ttcgagcggctggtgca

SEQ ID NO: 9029 - DNA, 17 bp, Artificial sequence
  Synthesized sequence
gtggcaatggacgtgac

SEQ ID NO: 9030 - DNA, 17 bp, Artificial sequence
  Synthesized sequence
ctgaccctggaatggct

SEQ ID NO: 9031 - DNA, 17 bp, Artificial sequence
  Synthesized sequence
acgccacgctgcgtgcc

SEQ ID NO: 9032 - DNA, 17 bp, Artificial sequence
  Synthesized sequence
gtcggacgaccgtggcc

SEQ ID NO: 9033 - DNA, 17 bp, Artificial sequence
  Synthesized sequence
caggcgcggataatggt

SEQ ID NO: 9034 - DNA, 17 bp, Artificial sequence
  Synthesized sequence
ctggaaggaccggtgga

SEQ ID NO: 9035 - DNA, 17 bp, Artificial sequence
  Synthesized sequence
attgcacggggtacgcg

SEQ ID NO: 9036 - DNA, 17 bp, Artificial sequence
  Synthesized sequence
gaggcggccttgttgcc

SEQ ID NO: 9037 - DNA, 17 bp, Artificial sequence
  Synthesized sequence
ctgggacccggactgga

SEQ ID NO: 9038 - DNA, 17 bp, Artificial sequence
  Synthesized sequence
atgggaacccagtagcg

SEQ ID NO: 9039 - DNA, 17 bp, Artificial sequence
  Synthesized sequence
gtggctccctggctggt

SEQ ID NO: 9040 - DNA, 17 bp, Artificial sequence
  Synthesized sequence
gtgcaaggcaacgtgca

SEQ ID NO: 9041 - DNA, 17 bp, Artificial sequence
  Synthesized sequence
ttggcggggtttttctt

SEQ ID NO: 9042 - DNA, 17 bp, Artificial sequence
  Synthesized sequence
ctggaactgccagggcg

SEQ ID NO: 9043 - DNA, 17 bp, Artificial sequence
  Synthesized sequence
gtgccgcgtttctcgcc

SEQ ID NO: 9044 - DNA, 17 bp, Artificial sequence
  Synthesized sequence
ctcgctctgctcctgcc

SEQ ID NO: 9045 - DNA, 17 bp, Artificial sequence
  Synthesized sequence
aaggccggcgattcgct

SEQ ID NO: 9046 - DNA, 17 bp, Artificial sequence
  Synthesized sequence
aaggccggcgattcgct

SEQ ID NO: 9047 - DNA, 17 bp, Artificial sequence
  Synthesized sequence
atggcctggtaggcgcg

SEQ ID NO: 9048 - DNA, 17 bp, Artificial sequence
  Synthesized sequence
gtggaattgatgaagct

SEQ ID NO: 9049 - DNA, 17 bp, Artificial sequence
  Synthesized sequence
gtggtgcgggcgcggca

SEQ ID NO: 9050 - DNA, 17 bp, Artificial sequence
  Synthesized sequence
cgggcgcggcaggtgat

SEQ ID NO: 9051 - DNA, 17 bp, Artificial sequence
  Synthesized sequence
agggcgccagcttagca

SEQ ID NO: 9052 - DNA, 17 bp, Artificial sequence
  Synthesized sequence
cgggctgagtccctgct

SEQ ID NO: 9053 - DNA, 17 bp, Artificial sequence
  Synthesized sequence
gtcggtcgatgattgcc

SEQ ID NO: 9054 - DNA, 17 bp, Artificial sequence
  Synthesized sequence
ctggctgagccaaggct

SEQ ID NO: 9055 - DNA, 17 bp, Artificial sequence
  Synthesized sequence
ctggcaatgaggcggcc

SEQ ID NO: 9056 - DNA, 17 bp, Artificial sequence
  Synthesized sequence
ctgcgatgaacggtgca

SEQ ID NO: 9057 - DNA, 17 bp, Artificial sequence
  Synthesized sequence
ctggcccgtggacggcg

SEQ ID NO: 9058 - DNA, 17 bp, Artificial sequence
  Synthesized sequence
ccggcgcggcgccggca

SEQ ID NO: 9059 - DNA, 17 bp, Artificial sequence
  Synthesized sequence
ttggcgctgggctgcca

SEQ ID NO: 9060 - DNA, 17 bp, Artificial sequence
  Synthesized sequence
atgccgcgcgcctggcg

SEQ ID NO: 9061 - DNA, 17 bp, Artificial sequence
  Synthesized sequence
ctggcgccgcgcgagcg

SEQ ID NO: 9062 - DNA, 17 bp, Artificial sequence
  Synthesized sequence
caggctccggtgctgcc

SEQ ID NO: 9063 - DNA, 17 bp, Artificial sequence
  Synthesized sequence
ctggatcgccagcggct

SEQ ID NO: 9064 - DNA, 17 bp, Artificial sequence
  Synthesized sequence
caggccttcctctcgct

SEQ ID NO: 9065 - DNA, 17 bp, Artificial sequence
  Synthesized sequence
cgggcgcggcagatggt

SEQ ID NO: 9066 - DNA, 17 bp, Artificial sequence
  Synthesized sequence
cttgcaggacgccggct

SEQ ID NO: 9067 - DNA, 17 bp, Artificial sequence
  Synthesized sequence
ctggaacggctaaaggt

SEQ ID NO: 9068 - DNA, 17 bp, Artificial sequence
  Synthesized sequence
atggaaggcgcgccgct

SEQ ID NO: 9069 - DNA, 17 bp, Artificial sequence
  Synthesized sequence
ctggacgcgcgcctgct

SEQ ID NO: 9070 - DNA, 17 bp, Artificial sequence
  Synthesized sequence
acggcaaggaactgcct

SEQ ID NO: 9071 - DNA, 17 bp, Artificial sequence
  Synthesized sequence
gcggcacgcacctggtg

SEQ ID NO: 9072 - DNA, 17 bp, Artificial sequence
  Synthesized sequence
gttgccctgacgtggct

SEQ ID NO: 9073 - DNA, 17 bp, Artificial sequence
  Synthesized sequence
ctggggcggcggctact

SEQ ID NO: 9074 - DNA, 17 bp, Artificial sequence
  Synthesized sequence
gttgcatgcatgctcct

SEQ ID NO: 9075 - DNA, 17 bp, Artificial sequence
  Synthesized sequence
ctggcagcgcggcggcc

SEQ ID NO: 9076 - DNA, 17 bp, Artificial sequence
  Synthesized sequence
cgggcaacagccgtgcg

SEQ ID NO: 9077 - DNA, 17 bp, Artificial sequence
  Synthesized sequence
tgggcgcggtggtttcg

SEQ ID NO: 9078 - DNA, 17 bp, Artificial sequence
  Synthesized sequence
ctgccgtcggggttgcg

SEQ ID NO: 9079 - DNA, 17 bp, Artificial sequence
  Synthesized sequence
aacgcaccgaactggca

SEQ ID NO: 9080 - DNA, 17 bp, Artificial sequence
  Synthesized sequence
ccgacccgctgcttgcg

SEQ ID NO: 9081 - DNA, 17 bp, Artificial sequence
  Synthesized sequence
gtggcacgccagagccc

SEQ ID NO: 9082 - DNA, 17 bp, Artificial sequence
  Synthesized sequence
gaggccttgcaactgca

SEQ ID NO: 9083 - DNA, 17 bp, Artificial sequence
  Synthesized sequence
atcgtccatcccttgcg

SEQ ID NO: 9084 - DNA, 17 bp, Artificial sequence
  Synthesized sequence
gtggtaatgctgctgtt

SEQ ID NO: 9085 - DNA, 17 bp, Artificial sequence
  Synthesized sequence
gtggtggtaatgctgct

SEQ ID NO: 9086 - DNA, 17 bp, Artificial sequence
  Synthesized sequence
ctggtggtggtaatgct

SEQ ID NO: 9087 - DNA, 17 bp, Artificial sequence
  Synthesized sequence
aacgtacagaccttgcg

SEQ ID NO: 9088 - DNA, 17 bp, Artificial sequence
  Synthesized sequence
agggcgtactcctcgct

SEQ ID NO: 9089 - DNA, 17 bp, Artificial sequence
  Synthesized sequence
ctcgcactccagcagct

SEQ ID NO: 9090 - DNA, 17 bp, Artificial sequence
  Synthesized sequence
ctggcggcacaatagcg

SEQ ID NO: 9091 - DNA, 17 bp, Artificial sequence
  Synthesized sequence
ccggcagcgggggtgcg

SEQ ID NO: 9092 - DNA, 17 bp, Artificial sequence
  Synthesized sequence
ctcgctcgtgacgtgcg

SEQ ID NO: 9093 - DNA, 17 bp, Artificial sequence
  Synthesized sequence
ttagcatgaaagctcct

SEQ ID NO: 9094 - DNA, 17 bp, Artificial sequence
  Synthesized sequence
aaggcataccgtgcgct

SEQ ID NO: 9095 - DNA, 17 bp, Artificial sequence
  Synthesized sequence
gtggcagcattgctggc

SEQ ID NO: 9096 - DNA, 17 bp, Artificial sequence
  Synthesized sequence
atcgaaccgctgctgcg

SEQ ID NO: 9097 - DNA, 17 bp, Artificial sequence
  Synthesized sequence
gtggccaaggtgctgtt

SEQ ID NO: 9098 - DNA, 17 bp, Artificial sequence
  Synthesized sequence
caggcgcgcatccggca

SEQ ID NO: 9099 - DNA, 17 bp, Artificial sequence
  Synthesized sequence
gcggcgcggcacatcct

SEQ ID NO: 9100 - DNA, 17 bp, Artificial sequence
  Synthesized sequence
ctggaccgcgatcggct

SEQ ID NO: 9101 - DNA, 17 bp, Artificial sequence
  Synthesized sequence
ctgtccctgctgctgcg

SEQ ID NO: 9102 - DNA, 17 bp, Artificial sequence
  Synthesized sequence
accgtacagcaattgcg

SEQ ID NO: 9103 - DNA, 17 bp, Artificial sequence
  Synthesized sequence
tgggcctggcactggcc

SEQ ID NO: 9104 - DNA, 17 bp, Artificial sequence
  Synthesized sequence
ccgacacaaagctttct

SEQ ID NO: 9105 - DNA, 17 bp, Artificial sequence
  Synthesized sequence
ctggcgaagaacatcct

SEQ ID NO: 9106 - DNA, 17 bp, Artificial sequence
  Synthesized sequence
atcgccagcgacctgct

SEQ ID NO: 9107 - DNA, 17 bp, Artificial sequence
  Synthesized sequence
gcggagcggccttcgct

SEQ ID NO: 9108 - DNA, 17 bp, Artificial sequence
  Synthesized sequence
ctgggagtcggtctgcg

SEQ ID NO: 9109 - DNA, 17 bp, Artificial sequence
  Synthesized sequence
gtgatgcggcaggtgct

SEQ ID NO: 9110 - DNA, 17 bp, Artificial sequence
  Synthesized sequence
ctcgaataccgcctgca

SEQ ID NO: 9111 - DNA, 17 bp, Artificial sequence
  Synthesized sequence
cgggtgcagtttctgct

SEQ ID NO: 9112 - DNA, 17 bp, Artificial sequence
  Synthesized sequence
atggcgcggcatcggat

SEQ ID NO: 9113 - DNA, 17 bp, Artificial sequence
  Synthesized sequence
gtgcgccgcctgctgct

SEQ ID NO: 9114 - DNA, 17 bp, Artificial sequence
  Synthesized sequence
atggccttcctcgtcct

SEQ ID NO: 9115 - DNA, 17 bp, Artificial sequence
  Synthesized sequence
gttgccggcaccgtgca

SEQ ID NO: 9116 - DNA, 17 bp, Artificial sequence
  Synthesized sequence
atggcgcggcccgaggt

SEQ ID NO: 9117 - DNA, 17 bp, Artificial sequence
  Synthesized sequence
gtggtcgaggttttcct

SEQ ID NO: 9118 - DNA, 17 bp, Artificial sequence
  Synthesized sequence
cacgcatgcctttttct

SEQ ID NO: 9119 - DNA, 17 bp, Artificial sequence
  Synthesized sequence
atggccgacctgctgga

SEQ ID NO: 9120 - DNA, 17 bp, Artificial sequence
  Synthesized sequence
caggtgcagcagatgct

SEQ ID NO: 9121 - DNA, 17 bp, Artificial sequence
  Synthesized sequence
tcggcattggccttggc

SEQ ID NO: 9122 - DNA, 17 bp, Artificial sequence
  Synthesized sequence
aaggcccgcctgctgta

SEQ ID NO: 9123 - DNA, 17 bp, Artificial sequence
  Synthesized sequence
gtggcaggcatcgccca

SEQ ID NO: 9124 - DNA, 17 bp, Artificial sequence
  Synthesized sequence
atgggccgggcgctgat

SEQ ID NO: 9125 - DNA, 17 bp, Artificial sequence
  Synthesized sequence
gtgggccggggtcggct

SEQ ID NO: 9126 - DNA, 17 bp, Artificial sequence
  Synthesized sequence
ctgccggcgttgttgcc

SEQ ID NO: 9127 - DNA, 17 bp, Artificial sequence
  Synthesized sequence
gcgacgcgctgcttgcc

SEQ ID NO: 9128 - DNA, 17 bp, Artificial sequence
  Synthesized sequence
gcggcaatgtcggtgcc

SEQ ID NO: 9129 - DNA, 17 bp, Artificial sequence
  Synthesized sequence
ggggcgcgggacgcgct

SEQ ID NO: 9130 - DNA, 17 bp, Artificial sequence
  Synthesized sequence
gtggccggcctgtacct

SEQ ID NO: 9131 - DNA, 17 bp, Artificial sequence
  Synthesized sequence
gtggtgagtttcctgcg

SEQ ID NO: 9132 - DNA, 17 bp, Artificial sequence
  Synthesized sequence
ctggcgaacaggttgac

SEQ ID NO: 9133 - DNA, 17 bp, Artificial sequence
  Synthesized sequence
tgggcgcggtgatttcg

SEQ ID NO: 9134 - DNA, 17 bp, Artificial sequence
  Synthesized sequence
ctggagcggagcctgga

SEQ ID NO: 9135 - DNA, 17 bp, Artificial sequence
  Synthesized sequence
gcggcaccgatgcagcg

SEQ ID NO: 9136 - DNA, 17 bp, Artificial sequence
  Synthesized sequence
cggtcccggctggtgct

SEQ ID NO: 9137 - DNA, 17 bp, Artificial sequence
  Synthesized sequence
aaggccagcctgctgcg

SEQ ID NO: 9138 - DNA, 17 bp, Artificial sequence
  Synthesized sequence
caggctaacgcgttgcc

SEQ ID NO: 9139 - DNA, 17 bp, Artificial sequence
  Synthesized sequence
gccgaaggccatttgct

SEQ ID NO: 9140 - DNA, 17 bp, Artificial sequence
  Synthesized sequence
tgggcatagtggcggct

SEQ ID NO: 9141 - DNA, 17 bp, Artificial sequence
  Synthesized sequence
ctcgccctccgttcgct

SEQ ID NO: 9142 - DNA, 17 bp, Artificial sequence
  Synthesized sequence
ttggttcaaatccagct

SEQ ID NO: 9143 - DNA, 17 bp, Artificial sequence
  Synthesized sequence
gtggccggccgaaggca

SEQ ID NO: 9144 - DNA, 17 bp, Artificial sequence
  Synthesized sequence
ttggcgatgcggttgag

SEQ ID NO: 9145 - DNA, 17 bp, Artificial sequence
  Synthesized sequence
gcgcgaaggaagttgct

SEQ ID NO: 9146 - DNA, 17 bp, Artificial sequence
  Synthesized sequence
ttggcgttggtcaggca

SEQ ID NO: 9147 - DNA, 17 bp, Artificial sequence
  Synthesized sequence
cgggctgggcaatttct

SEQ ID NO: 9148 - DNA, 17 bp, Artificial sequence
  Synthesized sequence
atgtcgaggccatggct

SEQ ID NO: 9149 - DNA, 17 bp, Artificial sequence
  Synthesized sequence
aacgctcatgccttgct

SEQ ID NO: 9150 - DNA, 17 bp, Artificial sequence
  Synthesized sequence
ttgacaaagaggtcgcg

SEQ ID NO: 9151 - DNA, 17 bp, Artificial sequence
  Synthesized sequence
ttgacaaagaggtcgcg

SEQ ID NO: 9152 - DNA, 17 bp, Artificial sequence
  Synthesized sequence
ctggccagacgggttca

SEQ ID NO: 9153 - DNA, 17 bp, Artificial sequence
  Synthesized sequence
gtggcaagcctgataaa

SEQ ID NO: 9154 - DNA, 17 bp, Artificial sequence
  Synthesized sequence
ttgccacgccggaagcg

SEQ ID NO: 9155 - DNA, 17 bp, Artificial sequence
  Synthesized sequence
ctggcagtgagtcggcg

SEQ ID NO: 9156 - DNA, 17 bp, Artificial sequence
  Synthesized sequence
gtcgcatggccggtgaa

SEQ ID NO: 9157 - DNA, 17 bp, Artificial sequence
  Synthesized sequence
atggccggcgccctgta

SEQ ID NO: 9158 - DNA, 17 bp, Artificial sequence
  Synthesized sequence
atgacatttttattaca

SEQ ID NO: 9159 - DNA, 17 bp, Artificial sequence
  Synthesized sequence
ctggcgggcagcctgaa

SEQ ID NO: 9160 - DNA, 17 bp, Artificial sequence
  Synthesized sequence
gggggaggcgaaatgct

SEQ ID NO: 9161 - DNA, 17 bp, Artificial sequence
  Synthesized sequence
aagccatggatttttca

SEQ ID NO: 9162 - DNA, 17 bp, Artificial sequence
  Synthesized sequence
atggcgggcctgtagga

SEQ ID NO: 9163 - DNA, 17 bp, Artificial sequence
  Synthesized sequence
atggcaagggttcgtca

SEQ ID NO: 9164 - DNA, 17 bp, Artificial sequence
  Synthesized sequence
atggaatgagcgtagaa

SEQ ID NO: 9165 - DNA, 17 bp, Artificial sequence
  Synthesized sequence
caggcacttcggccgct

SEQ ID NO: 9166 - DNA, 17 bp, Artificial sequence
  Synthesized sequence
tccggaaagcttttgct

SEQ ID NO: 9167 - DNA, 17 bp, Artificial sequence
  Synthesized sequence
gctgcacaccgtttgga

SEQ ID NO: 9168 - DNA, 17 bp, Artificial sequence
  Synthesized sequence
ctggcgagcagtaggca

SEQ ID NO: 9169 - DNA, 17 bp, Artificial sequence
  Synthesized sequence
ttgaaaccccctttgat

SEQ ID NO: 9170 - DNA, 17 bp, Artificial sequence
  Synthesized sequence
atgtgatgctctctgca

SEQ ID NO: 9171 - DNA, 17 bp, Artificial sequence
  Synthesized sequence
atgtgatgctctctgca

SEQ ID NO: 9172 - DNA, 17 bp, Artificial sequence
  Synthesized sequence
atggcgcttctttcgga

SEQ ID NO: 9173 - DNA, 17 bp, Artificial sequence
  Synthesized sequence
gtgccaaatttctcgcg

SEQ ID NO: 9174 - DNA, 17 bp, Artificial sequence
  Synthesized sequence
ctggcgctgctctgccg

SEQ ID NO: 9175 - DNA, 17 bp, Artificial sequence
  Synthesized sequence
ccgggatggccctggcg

SEQ ID NO: 9176 - DNA, 17 bp, Artificial sequence
  Synthesized sequence
gtggcgatcaccttgag

SEQ ID NO: 9177 - DNA, 17 bp, Artificial sequence
  Synthesized sequence
tcggaacggcgaaggct

SEQ ID NO: 9178 - DNA, 17 bp, Artificial sequence
  Synthesized sequence
atggccggtgtgcggca

SEQ ID NO: 9179 - DNA, 17 bp, Artificial sequence
  Synthesized sequence
atggcgtcctggtggcg

SEQ ID NO: 9180 - DNA, 17 bp, Artificial sequence
  Synthesized sequence
cgggagggcgagttgca

SEQ ID NO: 9181 - DNA, 17 bp, Artificial sequence
  Synthesized sequence
atcgccctcgacatgca

SEQ ID NO: 9182 - DNA, 17 bp, Artificial sequence
  Synthesized sequence
ccgccacggcggtcgcg

SEQ ID NO: 9183 - DNA, 17 bp, Artificial sequence
  Synthesized sequence
caggtaggccgcttcca

SEQ ID NO: 9184 - DNA, 17 bp, Artificial sequence
  Synthesized sequence
acggcgcggcgccggca

SEQ ID NO: 9185 - DNA, 17 bp, Artificial sequence
  Synthesized sequence
gcgacattgccgttgcc

SEQ ID NO: 9186 - DNA, 17 bp, Artificial sequence
  Synthesized sequence
cgggcgagccgctggca

SEQ ID NO: 9187 - DNA, 17 bp, Artificial sequence
  Synthesized sequence
gtgccgctacgctggca

SEQ ID NO: 9188 - DNA, 17 bp, Artificial sequence
  Synthesized sequence
ttcgccctcgccatgca

SEQ ID NO: 9189 - DNA, 17 bp, Artificial sequence
  Synthesized sequence
ctggcaggaaaccgact

SEQ ID NO: 9190 - DNA, 17 bp, Artificial sequence
  Synthesized sequence
gaggccagcgactggca

SEQ ID NO: 9191 - DNA, 17 bp, Artificial sequence
  Synthesized sequence
ccggcggcggcattgcc

SEQ ID NO: 9192 - DNA, 17 bp, Artificial sequence
  Synthesized sequence
ttcgccggcaccgtgca

SEQ ID NO: 9193 - DNA, 17 bp, Artificial sequence
  Synthesized sequence
cagttccggcacttgca

SEQ ID NO: 9194 - DNA, 17 bp, Artificial sequence
  Synthesized sequence
ctggaccgccgcgtggt

SEQ ID NO: 9195 - DNA, 17 bp, Artificial sequence
  Synthesized sequence
cgggcgtggccaatgcg

SEQ ID NO: 9196 - DNA, 17 bp, Artificial sequence
  Synthesized sequence
ctggcgccctgaatcct

SEQ ID NO: 9197 - DNA, 17 bp, Artificial sequence
  Synthesized sequence
gcgccatcgccgttgcc

SEQ ID NO: 9198 - DNA, 17 bp, Artificial sequence
  Synthesized sequence
aaggtcatgcttttgca

SEQ ID NO: 9199 - DNA, 17 bp, Artificial sequence
  Synthesized sequence
ctggccctgttgctgac

SEQ ID NO: 9200 - DNA, 17 bp, Artificial sequence
  Synthesized sequence
ctgggagtcctttttcc

SEQ ID NO: 9201 - DNA, 17 bp, Artificial sequence
  Synthesized sequence
ctgacctccagcttgcc

SEQ ID NO: 9202 - DNA, 17 bp, Artificial sequence
  Synthesized sequence
ttggccggtcccatggt

SEQ ID NO: 9203 - DNA, 17 bp, Artificial sequence
  Synthesized sequence
ttgccaagggtgccgct

SEQ ID NO: 9204 - DNA, 17 bp, Artificial sequence
  Synthesized sequence
gtggtgatggtgctgct

SEQ ID NO: 9205 - DNA, 17 bp, Artificial sequence
  Synthesized sequence
gtggtggccctgctgct

SEQ ID NO: 9206 - DNA, 17 bp, Artificial sequence
  Synthesized sequence
ctggtgctgctgttccg

SEQ ID NO: 9207 - DNA, 17 bp, Artificial sequence
  Synthesized sequence
gcggcccggcaagggca

SEQ ID NO: 9208 - DNA, 17 bp, Artificial sequence
  Synthesized sequence
gcggctcgctgttcgcc

SEQ ID NO: 9209 - DNA, 17 bp, Artificial sequence
  Synthesized sequence
ccggcacccgaggagca

SEQ ID NO: 9210 - DNA, 17 bp, Artificial sequence
  Synthesized sequence
ctggctggaccgcttct

SEQ ID NO: 9211 - DNA, 17 bp, Artificial sequence
  Synthesized sequence
atcgccagacagatgca

SEQ ID NO: 9212 - DNA, 17 bp, Artificial sequence
  Synthesized sequence
gtgaccggctacgtgca

SEQ ID NO: 9213 - DNA, 17 bp, Artificial sequence
  Synthesized sequence
aggacaccgacttcgct

SEQ ID NO: 9214 - DNA, 17 bp, Artificial sequence
  Synthesized sequence
gaggcatgagaaatgga

SEQ ID NO: 9215 - DNA, 17 bp, Artificial sequence
  Synthesized sequence
gcggcgatatctttgcg

SEQ ID NO: 9216 - DNA, 17 bp, Artificial sequence
  Synthesized sequence
gcggcaaatcccttccg

SEQ ID NO: 9217 - DNA, 17 bp, Artificial sequence
  Synthesized sequence
ttgggacggtatttcgc

SEQ ID NO: 9218 - DNA, 17 bp, Artificial sequence
  Synthesized sequence
ctcgcctactacctgct

SEQ ID NO: 9219 - DNA, 17 bp, Artificial sequence
  Synthesized sequence
gcggcctaggcttggct

SEQ ID NO: 9220 - DNA, 17 bp, Artificial sequence
  Synthesized sequence
caggtgcggcccttcca

SEQ ID NO: 9221 - DNA, 17 bp, Artificial sequence
  Synthesized sequence
ctggcgggcgaagtgtt

SEQ ID NO: 9222 - DNA, 17 bp, Artificial sequence
  Synthesized sequence
tcggcgaggcgtttgga

SEQ ID NO: 9223 - DNA, 17 bp, Artificial sequence
  Synthesized sequence
caggcaccagagcagca

SEQ ID NO: 9224 - DNA, 17 bp, Artificial sequence
  Synthesized sequence
ttggaacatccttatca

SEQ ID NO: 9225 - DNA, 17 bp, Artificial sequence
  Synthesized sequence
cgggcgccacgcatgcg

SEQ ID NO: 9226 - DNA, 17 bp, Artificial sequence
  Synthesized sequence
gtggccgcggtattccg

SEQ ID NO: 9227 - DNA, 17 bp, Artificial sequence
  Synthesized sequence
atgtcgagcaaggtgct

SEQ ID NO: 9228 - DNA, 17 bp, Artificial sequence
  Synthesized sequence
ttcggacggcaccggct

SEQ ID NO: 9229 - DNA, 17 bp, Artificial sequence
  Synthesized sequence
ctggcctggcaacttcg

SEQ ID NO: 9230 - DNA, 17 bp, Artificial sequence
  Synthesized sequence
gccgcatgggtcttgga

SEQ ID NO: 9231 - DNA, 17 bp, Artificial sequence
  Synthesized sequence
ctggcgctggttcggcc

SEQ ID NO: 9232 - DNA, 17 bp, Artificial sequence
  Synthesized sequence
ctggcgtcacctgcgct

SEQ ID NO: 9233 - DNA, 17 bp, Artificial sequence
  Synthesized sequence
ctgccgctgctctcgcg

SEQ ID NO: 9234 - DNA, 17 bp, Artificial sequence
  Synthesized sequence
aaggaaccgcctatgcc

SEQ ID NO: 9235 - DNA, 17 bp, Artificial sequence
  Synthesized sequence
ttggcgggacttttcta

SEQ ID NO: 9236 - DNA, 17 bp, Artificial sequence
  Synthesized sequence
cgggcgcacgagctgcc

SEQ ID NO: 9237 - DNA, 17 bp, Artificial sequence
  Synthesized sequence
ctgaaaaagcgcctgct

SEQ ID NO: 9238 - DNA, 17 bp, Artificial sequence
  Synthesized sequence
ttggccagcactgggca

SEQ ID NO: 9239 - DNA, 17 bp, Artificial sequence
  Synthesized sequence
ttggttccgttgtagcc

SEQ ID NO: 9240 - DNA, 17 bp, Artificial sequence
  Synthesized sequence
gcggctagctatctgca

SEQ ID NO: 9241 - DNA, 17 bp, Artificial sequence
  Synthesized sequence
ctggaactgcgccagcg

SEQ ID NO: 9242 - DNA, 17 bp, Artificial sequence
  Synthesized sequence
ctggccagcgacctgga

SEQ ID NO: 9243 - DNA, 17 bp, Artificial sequence
  Synthesized sequence
ctcgcacaccattgcca

SEQ ID NO: 9244 - DNA, 17 bp, Artificial sequence
  Synthesized sequence
ttgagcccgatcttgcg

SEQ ID NO: 9245 - DNA, 17 bp, Artificial sequence
  Synthesized sequence
ccggcccggcgcctgta

SEQ ID NO: 9246 - DNA, 17 bp, Artificial sequence
  Synthesized sequence
gccggactagacttgca

SEQ ID NO: 9247 - DNA, 17 bp, Artificial sequence
  Synthesized sequence
ccggcacaatgcgcgcc

SEQ ID NO: 9248 - DNA, 17 bp, Artificial sequence
  Synthesized sequence
atggccagggcgctgta

SEQ ID NO: 9249 - DNA, 17 bp, Artificial sequence
  Synthesized sequence
tcggtgccggccttgcg

SEQ ID NO: 9250 - DNA, 17 bp, Artificial sequence
  Synthesized sequence
ctggacagggtctcgcg

SEQ ID NO: 9251 - DNA, 17 bp, Artificial sequence
  Synthesized sequence
cgggcgtgcaggtttct

SEQ ID NO: 9252 - DNA, 17 bp, Artificial sequence
  Synthesized sequence
cgggcgtgcaggtttct

SEQ ID NO: 9253 - DNA, 17 bp, Artificial sequence
  Synthesized sequence
cgggccggccagtagct

SEQ ID NO: 9254 - DNA, 17 bp, Artificial sequence
  Synthesized sequence
ctggtcggccgcctgcg

SEQ ID NO: 9255 - DNA, 17 bp, Artificial sequence
  Synthesized sequence
attgcagaggctgtgcc

SEQ ID NO: 9256 - DNA, 17 bp, Artificial sequence
  Synthesized sequence
tcggcggcgatcctgca

SEQ ID NO: 9257 - DNA, 17 bp, Artificial sequence
  Synthesized sequence
gttgcacggcggctacg

SEQ ID NO: 9258 - DNA, 17 bp, Artificial sequence
  Synthesized sequence
tgggcatccagttcgcc

SEQ ID NO: 9259 - DNA, 17 bp, Artificial sequence
  Synthesized sequence
gtggcgcaggtcttcac

SEQ ID NO: 9260 - DNA, 17 bp, Artificial sequence
  Synthesized sequence
aacgcccgggaattgcc

SEQ ID NO: 9261 - DNA, 17 bp, Artificial sequence
  Synthesized sequence
atagaagacgccttgcg

SEQ ID NO: 9262 - DNA, 17 bp, Artificial sequence
  Synthesized sequence
gagggtcgcttcgtgca

SEQ ID NO: 9263 - DNA, 17 bp, Artificial sequence
  Synthesized sequence
ctggcaacgcgcgtacc

SEQ ID NO: 9264 - DNA, 17 bp, Artificial sequence
  Synthesized sequence
gcggcggcgctgatgct

SEQ ID NO: 9265 - DNA, 17 bp, Artificial sequence
  Synthesized sequence
gcggcgctgatgctgcc

SEQ ID NO: 9266 - DNA, 17 bp, Artificial sequence
  Synthesized sequence
cgggaaagacaatggca

SEQ ID NO: 9267 - DNA, 17 bp, Artificial sequence
  Synthesized sequence
atggcagggcaagcgta

SEQ ID NO: 9268 - DNA, 17 bp, Artificial sequence
  Synthesized sequence
atggtcggcaggttgaa

SEQ ID NO: 9269 - DNA, 17 bp, Artificial sequence
  Synthesized sequence
cgggaaaactttctgca

SEQ ID NO: 9270 - DNA, 17 bp, Artificial sequence
  Synthesized sequence
tgggtccatactttgcg

SEQ ID NO: 9271 - DNA, 17 bp, Artificial sequence
  Synthesized sequence
gcggcatgaacgtcggt

SEQ ID NO: 9272 - DNA, 17 bp, Artificial sequence
  Synthesized sequence
tgcgcccaccttttgcc

SEQ ID NO: 9273 - DNA, 17 bp, Artificial sequence
  Synthesized sequence
atgccgcccttttttct

SEQ ID NO: 9274 - DNA, 17 bp, Artificial sequence
  Synthesized sequence
gtgccgccattgttcct

SEQ ID NO: 9275 - DNA, 17 bp, Artificial sequence
  Synthesized sequence
gtcgcagccaccttgga

SEQ ID NO: 9276 - DNA, 17 bp, Artificial sequence
  Synthesized sequence
gagaccctcgccttgct

SEQ ID NO: 9277 - DNA, 17 bp, Artificial sequence
  Synthesized sequence
ctggccctgcgcctggg

SEQ ID NO: 9278 - DNA, 17 bp, Artificial sequence
  Synthesized sequence
ctcggcagcccgttgct

SEQ ID NO: 9279 - DNA, 17 bp, Artificial sequence
  Synthesized sequence
ctggccggcgaaacgca

SEQ ID NO: 9280 - DNA, 17 bp, Artificial sequence
  Synthesized sequence
ctgtcgaaggcgttgcg

SEQ ID NO: 9281 - DNA, 17 bp, Artificial sequence
  Synthesized sequence
gtggagcggaaacttct

SEQ ID NO: 9282 - DNA, 17 bp, Artificial sequence
  Synthesized sequence
atgccataagccttggc

SEQ ID NO: 9283 - DNA, 17 bp, Artificial sequence
  Synthesized sequence
caggccgagaactggct

SEQ ID NO: 9284 - DNA, 17 bp, Artificial sequence
  Synthesized sequence
gtggcgcgcccgtgggc

SEQ ID NO: 9285 - DNA, 17 bp, Artificial sequence
  Synthesized sequence
ggggctcgtctattacc

SEQ ID NO: 9286 - DNA, 17 bp, Artificial sequence
  Synthesized sequence
gcggtagcaatcctgct

SEQ ID NO: 9287 - DNA, 17 bp, Artificial sequence
  Synthesized sequence
gcggctcgatgctttcc

SEQ ID NO: 9288 - DNA, 17 bp, Artificial sequence
  Synthesized sequence
ctgccagaccgtctgcc

SEQ ID NO: 9289 - DNA, 17 bp, Artificial sequence
  Synthesized sequence
ttggcgccttctgcgca

SEQ ID NO: 9290 - DNA, 17 bp, Artificial sequence
  Synthesized sequence
cgggcgctagttctgcg

SEQ ID NO: 9291 - DNA, 17 bp, Artificial sequence
  Synthesized sequence
ctggaactggaccggcg

SEQ ID NO: 9292 - DNA, 17 bp, Artificial sequence
  Synthesized sequence
caggaccaggcgttgcc

SEQ ID NO: 9293 - DNA, 17 bp, Artificial sequence
  Synthesized sequence
accgccctggccttgca

SEQ ID NO: 9294 - DNA, 17 bp, Artificial sequence
  Synthesized sequence
ttggccggctgacggct

SEQ ID NO: 9295 - DNA, 17 bp, Artificial sequence
  Synthesized sequence
ctggccggcgcgcggct

SEQ ID NO: 9296 - DNA, 17 bp, Artificial sequence
  Synthesized sequence
ctgaccaacctgctgct

SEQ ID NO: 9297 - DNA, 17 bp, Artificial sequence
  Synthesized sequence
gaggccggctggctgca

SEQ ID NO: 9298 - DNA, 17 bp, Artificial sequence
  Synthesized sequence
caggcgccgcaaatgcc

SEQ ID NO: 9299 - DNA, 17 bp, Artificial sequence
  Synthesized sequence
ctggtctggcagttgtc

SEQ ID NO: 9300 - DNA, 17 bp, Artificial sequence
  Synthesized sequence
gtggcgcgcctgcaggt

SEQ ID NO: 9301 - DNA, 17 bp, Artificial sequence
  Synthesized sequence
tatacacaggagttgct

SEQ ID NO: 9302 - DNA, 17 bp, Artificial sequence
  Synthesized sequence
acagcacggccatcgcc

SEQ ID NO: 9303 - DNA, 17 bp, Artificial sequence
  Synthesized sequence
atgggagctcatgtgcc

SEQ ID NO: 9304 - DNA, 17 bp, Artificial sequence
  Synthesized sequence
atggcgcaggggctggg

SEQ ID NO: 9305 - DNA, 17 bp, Artificial sequence
  Synthesized sequence
atggcgcaggggctggg

SEQ ID NO: 9306 - DNA, 17 bp, Artificial sequence
  Synthesized sequence
ccggccggcacatggct

SEQ ID NO: 9307 - DNA, 17 bp, Artificial sequence
  Synthesized sequence
atgtgccggccggtgct

SEQ ID NO: 9308 - DNA, 17 bp, Artificial sequence
  Synthesized sequence
gttgcgcgaccattggc

SEQ ID NO: 9309 - DNA, 17 bp, Artificial sequence
  Synthesized sequence
ctggtatgaccaccgcg

SEQ ID NO: 9310 - DNA, 17 bp, Artificial sequence
  Synthesized sequence
ccggcaggcgttcagca

SEQ ID NO: 9311 - DNA, 17 bp, Artificial sequence
  Synthesized sequence
ccggcaggcgttcagca

SEQ ID NO: 9312 - DNA, 17 bp, Artificial sequence
  Synthesized sequence
atcggtcgcgcattgcg

SEQ ID NO: 9313 - DNA, 17 bp, Artificial sequence
  Synthesized sequence
tttgaacgatagtagcg

SEQ ID NO: 9314 - DNA, 17 bp, Artificial sequence
  Synthesized sequence
gctgaagggccgttgca

SEQ ID NO: 9315 - DNA, 17 bp, Artificial sequence
  Synthesized sequence
ccggctcggtttccgca

SEQ ID NO: 9316 - DNA, 17 bp, Artificial sequence
  Synthesized sequence
gtgacgcgcaggctgcc

SEQ ID NO: 9317 - DNA, 17 bp, Artificial sequence
  Synthesized sequence
accgcacgcgtctggcc

SEQ ID NO: 9318 - DNA, 17 bp, Artificial sequence
  Synthesized sequence
caggcgggacggttgat

SEQ ID NO: 9319 - DNA, 17 bp, Artificial sequence
  Synthesized sequence
acggcattcgcgatgcg

SEQ ID NO: 9320 - DNA, 17 bp, Artificial sequence
  Synthesized sequence
ttggcgggcaggctgtt

SEQ ID NO: 9321 - DNA, 17 bp, Artificial sequence
  Synthesized sequence
gttgcaagccatcggct

SEQ ID NO: 9322 - DNA, 17 bp, Artificial sequence
  Synthesized sequence
tcggctagactcctgcc

SEQ ID NO: 9323 - DNA, 17 bp, Artificial sequence
  Synthesized sequence
gcggcgcgggtgaagct

SEQ ID NO: 9324 - DNA, 17 bp, Artificial sequence
  Synthesized sequence
caggcgctgccgctgcg

SEQ ID NO: 9325 - DNA, 17 bp, Artificial sequence
  Synthesized sequence
gtgccatcgacctggcc

SEQ ID NO: 9326 - DNA, 17 bp, Artificial sequence
  Synthesized sequence
ctggctcacgtcatggc

SEQ ID NO: 9327 - DNA, 17 bp, Artificial sequence
  Synthesized sequence
gtggcggcgggctggcc

SEQ ID NO: 9328 - DNA, 17 bp, Artificial sequence
  Synthesized sequence
atggtcaacgaagtgct

SEQ ID NO: 9329 - DNA, 17 bp, Artificial sequence
  Synthesized sequence
ccggcgcggcaaccgca

SEQ ID NO: 9330 - DNA, 17 bp, Artificial sequence
  Synthesized sequence
ctggtactcctcgtacg

SEQ ID NO: 9331 - DNA, 17 bp, Artificial sequence
  Synthesized sequence
gtgggtcaagcgatgcc

SEQ ID NO: 9332 - DNA, 17 bp, Artificial sequence
  Synthesized sequence
ctgccaggccgttttcg

SEQ ID NO: 9333 - DNA, 17 bp, Artificial sequence
  Synthesized sequence
ccgccacggcgatggcc

SEQ ID NO: 9334 - DNA, 17 bp, Artificial sequence
  Synthesized sequence
ctggccggcgactcggt

SEQ ID NO: 9335 - DNA, 17 bp, Artificial sequence
  Synthesized sequence
tgcgcatggcgctggca

SEQ ID NO: 9336 - DNA, 17 bp, Artificial sequence
  Synthesized sequence
gccgcgcggctctggct

SEQ ID NO: 9337 - DNA, 17 bp, Artificial sequence
  Synthesized sequence
ctgccgacgcccttgcc

SEQ ID NO: 9338 - DNA, 17 bp, Artificial sequence
  Synthesized sequence
ggggcaggggcacggct

SEQ ID NO: 9339 - DNA, 17 bp, Artificial sequence
  Synthesized sequence
ttggtcgaagccctgca

SEQ ID NO: 9340 - DNA, 17 bp, Artificial sequence
  Synthesized sequence
ttgccgaacatcctgct

SEQ ID NO: 9341 - DNA, 17 bp, Artificial sequence
  Synthesized sequence
gtgggcgttcgcttgcg

SEQ ID NO: 9342 - DNA, 17 bp, Artificial sequence
  Synthesized sequence
ctcgaacttcatgtgca

SEQ ID NO: 9343 - DNA, 17 bp, Artificial sequence
  Synthesized sequence
gcggcagaactgaggct

SEQ ID NO: 9344 - DNA, 17 bp, Artificial sequence
  Synthesized sequence
gcgacatcggccttgcg

SEQ ID NO: 9345 - DNA, 17 bp, Artificial sequence
  Synthesized sequence
tttgctagggtctggct

SEQ ID NO: 9346 - DNA, 17 bp, Artificial sequence
  Synthesized sequence
ctcgcgctcggcctgca

SEQ ID NO: 9347 - DNA, 17 bp, Artificial sequence
  Synthesized sequence
gtggcgcaggccgtgac

SEQ ID NO: 9348 - DNA, 17 bp, Artificial sequence
  Synthesized sequence
aaggtccgcgaactgct

SEQ ID NO: 9349 - DNA, 17 bp, Artificial sequence
  Synthesized sequence
gcggcaggtggatcgcc

SEQ ID NO: 9350 - DNA, 17 bp, Artificial sequence
  Synthesized sequence
atgggccgggtgatgga

SEQ ID NO: 9351 - DNA, 17 bp, Artificial sequence
  Synthesized sequence
ctggtgaagggcatgca

SEQ ID NO: 9352 - DNA, 17 bp, Artificial sequence
  Synthesized sequence
gtgccgcgcagctcgcc

SEQ ID NO: 9353 - DNA, 17 bp, Artificial sequence
  Synthesized sequence
cagggccgccatgtgca

SEQ ID NO: 9354 - DNA, 17 bp, Artificial sequence
  Synthesized sequence
ctcgctggggtgctgca

SEQ ID NO: 9355 - DNA, 17 bp, Artificial sequence
  Synthesized sequence
gttgcccggccatttcc

SEQ ID NO: 9356 - DNA, 17 bp, Artificial sequence
  Synthesized sequence
ctgactccgccgtggct

SEQ ID NO: 9357 - DNA, 17 bp, Artificial sequence
  Synthesized sequence
atcggccgacgcctgct

SEQ ID NO: 9358 - DNA, 17 bp, Artificial sequence
  Synthesized sequence
acgtcccagcctttgcg

SEQ ID NO: 9359 - DNA, 17 bp, Artificial sequence
  Synthesized sequence
cctgcgcggctggtgca

SEQ ID NO: 9360 - DNA, 17 bp, Artificial sequence
  Synthesized sequence
ttgctccatcccttgcg

SEQ ID NO: 9361 - DNA, 17 bp, Artificial sequence
  Synthesized sequence
tttgcgaagggattgcg

SEQ ID NO: 9362 - DNA, 17 bp, Artificial sequence
  Synthesized sequence
ctggcgccggccttcgt

SEQ ID NO: 9363 - DNA, 17 bp, Artificial sequence
  Synthesized sequence
gtgggcaaggaaatgct

SEQ ID NO: 9364 - DNA, 17 bp, Artificial sequence
  Synthesized sequence
ctcgcctggctggtgcg

SEQ ID NO: 9365 - DNA, 17 bp, Artificial sequence
  Synthesized sequence
atggccccggtgttcga

SEQ ID NO: 9366 - DNA, 17 bp, Artificial sequence
  Synthesized sequence
gtggtgtccagcgtgct

SEQ ID NO: 9367 - DNA, 17 bp, Artificial sequence
  Synthesized sequence
gtggtgtccagcgtgct

SEQ ID NO: 9368 - DNA, 17 bp, Artificial sequence
  Synthesized sequence
atgggcatgatgatgct

SEQ ID NO: 9369 - DNA, 17 bp, Artificial sequence
  Synthesized sequence
atgggcatgatgatgct

SEQ ID NO: 9370 - DNA, 17 bp, Artificial sequence
  Synthesized sequence
ctgctgctcggattgct

SEQ ID NO: 9371 - DNA, 17 bp, Artificial sequence
  Synthesized sequence
ctggccctggagtgcct

SEQ ID NO: 9372 - DNA, 17 bp, Artificial sequence
  Synthesized sequence
gctgctcatcggttgca

SEQ ID NO: 9373 - DNA, 17 bp, Artificial sequence
  Synthesized sequence
atgggccgcggattccg

SEQ ID NO: 9374 - DNA, 17 bp, Artificial sequence
  Synthesized sequence
atggccggccaggtgga

SEQ ID NO: 9375 - DNA, 17 bp, Artificial sequence
  Synthesized sequence
ttgccgtcgtggttgcg

SEQ ID NO: 9376 - DNA, 17 bp, Artificial sequence
  Synthesized sequence
aggtaacgcacgttgcg

SEQ ID NO: 9377 - DNA, 17 bp, Artificial sequence
  Synthesized sequence
attgcgcggctgccgct

SEQ ID NO: 9378 - DNA, 17 bp, Artificial sequence
  Synthesized sequence
ctggaccgacgggagct

SEQ ID NO: 9379 - DNA, 17 bp, Artificial sequence
  Synthesized sequence
attgctctgcacttcca

SEQ ID NO: 9380 - DNA, 17 bp, Artificial sequence
  Synthesized sequence
ctggccgggcattgcca

SEQ ID NO: 9381 - DNA, 17 bp, Artificial sequence
  Synthesized sequence
ctgacccaggaactgcg

SEQ ID NO: 9382 - DNA, 17 bp, Artificial sequence
  Synthesized sequence
ggggcgctggttatgcg

SEQ ID NO: 9383 - DNA, 17 bp, Artificial sequence
  Synthesized sequence
tgggaatcgccctggct

SEQ ID NO: 9384 - DNA, 17 bp, Artificial sequence
  Synthesized sequence
ctgccagggtttctact

SEQ ID NO: 9385 - DNA, 17 bp, Artificial sequence
  Synthesized sequence
atggcccgccgcttcgc

SEQ ID NO: 9386 - DNA, 17 bp, Artificial sequence
  Synthesized sequence
ttggccgcctacttgac

SEQ ID NO: 9387 - DNA, 17 bp, Artificial sequence
  Synthesized sequence
tcggcatcatgctggcc

SEQ ID NO: 9388 - DNA, 17 bp, Artificial sequence
  Synthesized sequence
caggccaatttcctgct

SEQ ID NO: 9389 - DNA, 17 bp, Artificial sequence
  Synthesized sequence
ctgccgctggcctggct

SEQ ID NO: 9390 - DNA, 17 bp, Artificial sequence
  Synthesized sequence
ctggcggcgctaacgct

SEQ ID NO: 9391 - DNA, 17 bp, Artificial sequence
  Synthesized sequence
atggactattgcgtgca

SEQ ID NO: 9392 - DNA, 17 bp, Artificial sequence
  Synthesized sequence
atgtcttcgctcatgca

SEQ ID NO: 9393 - DNA, 17 bp, Artificial sequence
  Synthesized sequence
ctggaaagcctgtagta

SEQ ID NO: 9394 - DNA, 17 bp, Artificial sequence
  Synthesized sequence
aaggcctcgccgctgct

SEQ ID NO: 9395 - DNA, 17 bp, Artificial sequence
  Synthesized sequence
gaggaacgcatccagca

SEQ ID NO: 9396 - DNA, 17 bp, Artificial sequence
  Synthesized sequence
gaggcccagctggcgct

SEQ ID NO: 9397 - DNA, 17 bp, Artificial sequence
  Synthesized sequence
atggccgacattctcct

SEQ ID NO: 9398 - DNA, 17 bp, Artificial sequence
  Synthesized sequence
ctggagcgcttcatcca

SEQ ID NO: 9399 - DNA, 17 bp, Artificial sequence
  Synthesized sequence
aaggcctgcctctggcc

SEQ ID NO: 9400 - DNA, 17 bp, Artificial sequence
  Synthesized sequence
gtggccaaggacaagct

SEQ ID NO: 9401 - DNA, 17 bp, Artificial sequence
  Synthesized sequence
gtggaaggcccgctgga

SEQ ID NO: 9402 - DNA, 17 bp, Artificial sequence
  Synthesized sequence
atggcggcaccttggcc

SEQ ID NO: 9403 - DNA, 17 bp, Artificial sequence
  Synthesized sequence
ttggcccacgccctggc

SEQ ID NO: 9404 - DNA, 17 bp, Artificial sequence
  Synthesized sequence
ctggcaccagtgctcta

SEQ ID NO: 9405 - DNA, 17 bp, Artificial sequence
  Synthesized sequence
attgcacgtcgcaggcg

SEQ ID NO: 9406 - DNA, 17 bp, Artificial sequence
  Synthesized sequence
cgcgctcgctccttgcg

SEQ ID NO: 9407 - DNA, 17 bp, Artificial sequence
  Synthesized sequence
gagggccgccgggtgct

SEQ ID NO: 9408 - DNA, 17 bp, Artificial sequence
  Synthesized sequence
ttggaaagcgctctgaa

SEQ ID NO: 9409 - DNA, 17 bp, Artificial sequence
  Synthesized sequence
ccggcctacccgtggct

SEQ ID NO: 9410 - DNA, 17 bp, Artificial sequence
  Synthesized sequence
caggatcaccagttgcc

SEQ ID NO: 9411 - DNA, 17 bp, Artificial sequence
  Synthesized sequence
tcgggaagccaattgat

SEQ ID NO: 9412 - DNA, 17 bp, Artificial sequence
  Synthesized sequence
ctggcgcagacctgggg

SEQ ID NO: 9413 - DNA, 17 bp, Artificial sequence
  Synthesized sequence
ccgggctcgaccttgca

SEQ ID NO: 9414 - DNA, 17 bp, Artificial sequence
  Synthesized sequence
ctggcgggccttttcaa

SEQ ID NO: 9415 - DNA, 17 bp, Artificial sequence
  Synthesized sequence
gttggccggtacctgca

SEQ ID NO: 9416 - DNA, 17 bp, Artificial sequence
  Synthesized sequence
ttggcggcggcctggcc

SEQ ID NO: 9417 - DNA, 17 bp, Artificial sequence
  Synthesized sequence
ctggccgctcctctgcc

SEQ ID NO: 9418 - DNA, 17 bp, Artificial sequence
  Synthesized sequence
ctggcgggggtatgggt

SEQ ID NO: 9419 - DNA, 17 bp, Artificial sequence
  Synthesized sequence
ctggcgggggtatgggt

SEQ ID NO: 9420 - DNA, 17 bp, Artificial sequence
  Synthesized sequence
gtggcgccggagttctt

SEQ ID NO: 9421 - DNA, 17 bp, Artificial sequence
  Synthesized sequence
gtcgaccgcgtcgtgct

SEQ ID NO: 9422 - DNA, 17 bp, Artificial sequence
  Synthesized sequence
gtcaaacgaatgttgcc

SEQ ID NO: 9423 - DNA, 17 bp, Artificial sequence
  Synthesized sequence
gttgccggagtgtcgct

SEQ ID NO: 9424 - DNA, 17 bp, Artificial sequence
  Synthesized sequence
gtggtacgcggcttatg

SEQ ID NO: 9425 - DNA, 17 bp, Artificial sequence
  Synthesized sequence
ctgccggcacccttgcg

SEQ ID NO: 9426 - DNA, 17 bp, Artificial sequence
  Synthesized sequence
ctgtccggccactcgct

SEQ ID NO: 9427 - DNA, 17 bp, Artificial sequence
  Synthesized sequence
ccggcgcgacggccgct

SEQ ID NO: 9428 - DNA, 17 bp, Artificial sequence
  Synthesized sequence
ttggccggcgtgctcca

SEQ ID NO: 9429 - DNA, 17 bp, Artificial sequence
  Synthesized sequence
tcggccggctggatgca

SEQ ID NO: 9430 - DNA, 17 bp, Artificial sequence
  Synthesized sequence
atggcgtgattgccgcg

SEQ ID NO: 9431 - DNA, 17 bp, Artificial sequence
  Synthesized sequence
ctgtcatgattcatcca

SEQ ID NO: 9432 - DNA, 17 bp, Artificial sequence
  Synthesized sequence
ttggcgatggcggtgcc

SEQ ID NO: 9433 - DNA, 17 bp, Artificial sequence
  Synthesized sequence
gtggctggcgaggcgct

SEQ ID NO: 9434 - DNA, 17 bp, Artificial sequence
  Synthesized sequence
tagggacctctttttca

SEQ ID NO: 9435 - DNA, 17 bp, Artificial sequence
  Synthesized sequence
ctggcgcgggcgttctg

SEQ ID NO: 9436 - DNA, 17 bp, Artificial sequence
  Synthesized sequence
gtgcagaagctgttgct

SEQ ID NO: 9437 - DNA, 17 bp, Artificial sequence
  Synthesized sequence
gcgccacgatactcgcg

SEQ ID NO: 9438 - DNA, 17 bp, Artificial sequence
  Synthesized sequence
gtcgcgcgtttttcgcc

SEQ ID NO: 9439 - DNA, 17 bp, Artificial sequence
  Synthesized sequence
gtgtcgcgcgtttttcg

SEQ ID NO: 9440 - DNA, 17 bp, Artificial sequence
  Synthesized sequence
cgggcacggcggtgggc

SEQ ID NO: 9441 - DNA, 17 bp, Artificial sequence
  Synthesized sequence
gcggcatcgtagtttcg

SEQ ID NO: 9442 - DNA, 17 bp, Artificial sequence
  Synthesized sequence
ttggttttcattgtgca

SEQ ID NO: 9443 - DNA, 17 bp, Artificial sequence
  Synthesized sequence
atcgaactgccgttgaa

SEQ ID NO: 9444 - DNA, 17 bp, Artificial sequence
  Synthesized sequence
ctggccaagcaggagct

SEQ ID NO: 9445 - DNA, 17 bp, Artificial sequence
  Synthesized sequence
ctggtaccgcgtcagcc

SEQ ID NO: 9446 - DNA, 17 bp, Artificial sequence
  Synthesized sequence
ctgccccaacggctgcg

SEQ ID NO: 9447 - DNA, 17 bp, Artificial sequence
  Synthesized sequence
ctggccctgcgtttcga

SEQ ID NO: 9448 - DNA, 17 bp, Artificial sequence
  Synthesized sequence
agggcatcctgaatgcc

SEQ ID NO: 9449 - DNA, 17 bp, Artificial sequence
  Synthesized sequence
ctggctcaaccggcgcc

SEQ ID NO: 9450 - DNA, 17 bp, Artificial sequence
  Synthesized sequence
gtgttccttgccttgct

SEQ ID NO: 9451 - DNA, 17 bp, Artificial sequence
  Synthesized sequence
gtggatcttcttgtgcg

SEQ ID NO: 9452 - DNA, 17 bp, Artificial sequence
  Synthesized sequence
ctggaacgcccatgtcc

SEQ ID NO: 9453 - DNA, 17 bp, Artificial sequence
  Synthesized sequence
gtgccggtggtcttgcc

SEQ ID NO: 9454 - DNA, 17 bp, Artificial sequence
  Synthesized sequence
ctgtgagggctgtggca

SEQ ID NO: 9455 - DNA, 17 bp, Artificial sequence
  Synthesized sequence
tcggcagttttcatgcg

SEQ ID NO: 9456 - DNA, 17 bp, Artificial sequence
  Synthesized sequence
ctggcagccttgctggc

SEQ ID NO: 9457 - DNA, 17 bp, Artificial sequence
  Synthesized sequence
caggcccggccgctgtt

SEQ ID NO: 9458 - DNA, 17 bp, Artificial sequence
  Synthesized sequence
ctggtatcgctggtcca

SEQ ID NO: 9459 - DNA, 17 bp, Artificial sequence
  Synthesized sequence
ctggtcctgtcgctgcc

SEQ ID NO: 9460 - DNA, 17 bp, Artificial sequence
  Synthesized sequence
ctggcccagcgaatacg

SEQ ID NO: 9461 - DNA, 17 bp, Artificial sequence
  Synthesized sequence
gaggtgcaggtcctgca

SEQ ID NO: 9462 - DNA, 17 bp, Artificial sequence
  Synthesized sequence
ctggccatgctcaagct

SEQ ID NO: 9463 - DNA, 17 bp, Artificial sequence
  Synthesized sequence
atggcgtggcgcatccg

SEQ ID NO: 9464 - DNA, 17 bp, Artificial sequence
  Synthesized sequence
ccggcgcagtcatcgcc

SEQ ID NO: 9465 - DNA, 17 bp, Artificial sequence
  Synthesized sequence
gttgcacaaggtatgaa

SEQ ID NO: 9466 - DNA, 17 bp, Artificial sequence
  Synthesized sequence
gttgcacaaggtatgaa

SEQ ID NO: 9467 - DNA, 17 bp, Artificial sequence
  Synthesized sequence
gttgcaggaggatggcg

SEQ ID NO: 9468 - DNA, 17 bp, Artificial sequence
  Synthesized sequence
ctggcggaggccacgct

SEQ ID NO: 9469 - DNA, 17 bp, Artificial sequence
  Synthesized sequence
ctgaaactcggcgtgca

SEQ ID NO: 9470 - DNA, 17 bp, Artificial sequence
  Synthesized sequence
atcgcgaggcggtcgct

SEQ ID NO: 9471 - DNA, 17 bp, Artificial sequence
  Synthesized sequence
atcgcgaggcggtcgct

SEQ ID NO: 9472 - DNA, 17 bp, Artificial sequence
  Synthesized sequence
gtggccgggctggcgcg

SEQ ID NO: 9473 - DNA, 17 bp, Artificial sequence
  Synthesized sequence
ctggccggcaagctgga

SEQ ID NO: 9474 - DNA, 17 bp, Artificial sequence
  Synthesized sequence
atggatcatctgttgag

SEQ ID NO: 9475 - DNA, 17 bp, Artificial sequence
  Synthesized sequence
ctggaaagcccgctgga

SEQ ID NO: 9476 - DNA, 17 bp, Artificial sequence
  Synthesized sequence
ctggcgccacgcttcga

SEQ ID NO: 9477 - DNA, 17 bp, Artificial sequence
  Synthesized sequence
ctggcgcagttcttctg

SEQ ID NO: 9478 - DNA, 17 bp, Artificial sequence
  Synthesized sequence
ctggctggccgcctgta

SEQ ID NO: 9479 - DNA, 17 bp, Artificial sequence
  Synthesized sequence
ctggtgcggcgctggat

SEQ ID NO: 9480 - DNA, 17 bp, Artificial sequence
  Synthesized sequence
tcggcacgctgctcgac

SEQ ID NO: 9481 - DNA, 17 bp, Artificial sequence
  Synthesized sequence
tcgccataggtcatgca

SEQ ID NO: 9482 - DNA, 17 bp, Artificial sequence
  Synthesized sequence
cgggcatggggagtcct

SEQ ID NO: 9483 - DNA, 17 bp, Artificial sequence
  Synthesized sequence
aaggagtcggccttgct

SEQ ID NO: 9484 - DNA, 17 bp, Artificial sequence
  Synthesized sequence
atgcactgggtcttgcc

SEQ ID NO: 9485 - DNA, 17 bp, Artificial sequence
  Synthesized sequence
ctgcaactccgctggca

SEQ ID NO: 9486 - DNA, 17 bp, Artificial sequence
  Synthesized sequence
acggcacccagctcgat

SEQ ID NO: 9487 - DNA, 17 bp, Artificial sequence
  Synthesized sequence
ctggaagcgctcgcgca

SEQ ID NO: 9488 - DNA, 17 bp, Artificial sequence
  Synthesized sequence
gcggcgccagttctgcc

SEQ ID NO: 9489 - DNA, 17 bp, Artificial sequence
  Synthesized sequence
agcgcgcaggtcttgcc

SEQ ID NO: 9490 - DNA, 17 bp, Artificial sequence
  Synthesized sequence
cgggccaacagcctgct

SEQ ID NO: 9491 - DNA, 17 bp, Artificial sequence
  Synthesized sequence
ctggccatcggcctgcc

SEQ ID NO: 9492 - DNA, 17 bp, Artificial sequence
  Synthesized sequence
tgggcaggagccccgca

SEQ ID NO: 9493 - DNA, 17 bp, Artificial sequence
  Synthesized sequence
ctggtcgccttcatgct

SEQ ID NO: 9494 - DNA, 17 bp, Artificial sequence
  Synthesized sequence
gcggcatcgctggcgca

SEQ ID NO: 9495 - DNA, 17 bp, Artificial sequence
  Synthesized sequence
ctgggcctgtcgctgcg

SEQ ID NO: 9496 - DNA, 17 bp, Artificial sequence
  Synthesized sequence
gtggcgaagatatcgat

SEQ ID NO: 9497 - DNA, 17 bp, Artificial sequence
  Synthesized sequence
atggtatcgaagatgat

SEQ ID NO: 9498 - DNA, 17 bp, Artificial sequence
  Synthesized sequence
cgcgaatacctgttgct

SEQ ID NO: 9499 - DNA, 17 bp, Artificial sequence
  Synthesized sequence
atgtgacgcaaatggcg

SEQ ID NO: 9500 - DNA, 17 bp, Artificial sequence
  Synthesized sequence
ctggctttaaggttgtg

SEQ ID NO: 9501 - DNA, 17 bp, Artificial sequence
  Synthesized sequence
ccgggcagatcattgca

SEQ ID NO: 9502 - DNA, 17 bp, Artificial sequence
  Synthesized sequence
gcggaactggagtttca

SEQ ID NO: 9503 - DNA, 17 bp, Artificial sequence
  Synthesized sequence
ttgaaagagctctggct

SEQ ID NO: 9504 - DNA, 17 bp, Artificial sequence
  Synthesized sequence
ctgcccgcgcaattgcg

SEQ ID NO: 9505 - DNA, 17 bp, Artificial sequence
  Synthesized sequence
ctggcgatcatatcgcc

SEQ ID NO: 9506 - DNA, 17 bp, Artificial sequence
  Synthesized sequence
ctcgcaggccttgtggt

SEQ ID NO: 9507 - DNA, 17 bp, Artificial sequence
  Synthesized sequence
gttgcatcgccgtcgcc

SEQ ID NO: 9508 - DNA, 17 bp, Artificial sequence
  Synthesized sequence
ctggcgcaggaagttcg

SEQ ID NO: 9509 - DNA, 17 bp, Artificial sequence
  Synthesized sequence
cgggcgcatataatgcc

SEQ ID NO: 9510 - DNA, 17 bp, Artificial sequence
  Synthesized sequence
ctggcggggtgacttct

SEQ ID NO: 9511 - DNA, 17 bp, Artificial sequence
  Synthesized sequence
gaggctgcgctcatgca

SEQ ID NO: 9512 - DNA, 17 bp, Artificial sequence
  Synthesized sequence
ttgctgcggcaactgca

SEQ ID NO: 9513 - DNA, 17 bp, Artificial sequence
  Synthesized sequence
ctggaaccgtttcggcc

SEQ ID NO: 9514 - DNA, 17 bp, Artificial sequence
  Synthesized sequence
ctggcgggtcgcctact

SEQ ID NO: 9515 - DNA, 17 bp, Artificial sequence
  Synthesized sequence
gtggtcgacgccatgct

SEQ ID NO: 9516 - DNA, 17 bp, Artificial sequence
  Synthesized sequence
ctggaaccagtcgcgcg

SEQ ID NO: 9517 - DNA, 17 bp, Artificial sequence
  Synthesized sequence
caggcgccctcttcgca

SEQ ID NO: 9518 - DNA, 17 bp, Artificial sequence
  Synthesized sequence
gtggcagtgggtccgcg

SEQ ID NO: 9519 - DNA, 17 bp, Artificial sequence
  Synthesized sequence
gaggcgcgcatcgtggt

SEQ ID NO: 9520 - DNA, 17 bp, Artificial sequence
  Synthesized sequence
ccggcctggccctggcc

SEQ ID NO: 9521 - DNA, 17 bp, Artificial sequence
  Synthesized sequence
gcggccagccccttcca

SEQ ID NO: 9522 - DNA, 17 bp, Artificial sequence
  Synthesized sequence
tcggcaataccctcgcc

SEQ ID NO: 9523 - DNA, 17 bp, Artificial sequence
  Synthesized sequence
tttgaatgtcattcgct

SEQ ID NO: 9524 - DNA, 17 bp, Artificial sequence
  Synthesized sequence
cgggcgacacgattgcg

SEQ ID NO: 9525 - DNA, 17 bp, Artificial sequence
  Synthesized sequence
cggtcacggtcctggcc

SEQ ID NO: 9526 - DNA, 17 bp, Artificial sequence
  Synthesized sequence
ctggcaataggccggcg

SEQ ID NO: 9527 - DNA, 17 bp, Artificial sequence
  Synthesized sequence
gtagcccgcccatagcg

SEQ ID NO: 9528 - DNA, 17 bp, Artificial sequence
  Synthesized sequence
ggcccacggatcttgcc

SEQ ID NO: 9529 - DNA, 17 bp, Artificial sequence
  Synthesized sequence
ttggtatcgcctcggca

SEQ ID NO: 9530 - DNA, 17 bp, Artificial sequence
  Synthesized sequence
aacgcactggtatggct

SEQ ID NO: 9531 - DNA, 17 bp, Artificial sequence
  Synthesized sequence
atcaccccgaccttgct

SEQ ID NO: 9532 - DNA, 17 bp, Artificial sequence
  Synthesized sequence
gtggtgccgagcttgtg

SEQ ID NO: 9533 - DNA, 17 bp, Artificial sequence
  Synthesized sequence
atggaaccgctgtcgac

SEQ ID NO: 9534 - DNA, 17 bp, Artificial sequence
  Synthesized sequence
ttggcgtagagggtgat

SEQ ID NO: 9535 - DNA, 17 bp, Artificial sequence
  Synthesized sequence
ctggccggcggcatggt

SEQ ID NO: 9536 - DNA, 17 bp, Artificial sequence
  Synthesized sequence
ctggctggccggcggca

SEQ ID NO: 9537 - DNA, 17 bp, Artificial sequence
  Synthesized sequence
ctggcctgcttcctggc

SEQ ID NO: 9538 - DNA, 17 bp, Artificial sequence
  Synthesized sequence
atgccatcaccgatgcc

SEQ ID NO: 9539 - DNA, 17 bp, Artificial sequence
  Synthesized sequence
ctggggctggacatgcc

SEQ ID NO: 9540 - DNA, 17 bp, Artificial sequence
  Synthesized sequence
gtggccctattgcagcg

SEQ ID NO: 9541 - DNA, 17 bp, Artificial sequence
  Synthesized sequence
ctcgttcggcaagtgct

SEQ ID NO: 9542 - DNA, 17 bp, Artificial sequence
  Synthesized sequence
gtcgccggccgggtgct

SEQ ID NO: 9543 - DNA, 17 bp, Artificial sequence
  Synthesized sequence
ttcgaaagcgacatgct

SEQ ID NO: 9544 - DNA, 17 bp, Artificial sequence
  Synthesized sequence
ctgaaccagtcgttgcg

SEQ ID NO: 9545 - DNA, 17 bp, Artificial sequence
  Synthesized sequence
atggtcttcaactcgct

SEQ ID NO: 9546 - DNA, 17 bp, Artificial sequence
  Synthesized sequence
gcggcacagcctgttcg

SEQ ID NO: 9547 - DNA, 17 bp, Artificial sequence
  Synthesized sequence
ccgggacgcctgacgct

SEQ ID NO: 9548 - DNA, 17 bp, Artificial sequence
  Synthesized sequence
tgggcgccccatctgcg

SEQ ID NO: 9549 - DNA, 17 bp, Artificial sequence
  Synthesized sequence
ctggtgcgccgcctgga

SEQ ID NO: 9550 - DNA, 17 bp, Artificial sequence
  Synthesized sequence
ctgggacaccccgttcg

SEQ ID NO: 9551 - DNA, 17 bp, Artificial sequence
  Synthesized sequence
cgggcacggggaatacc

SEQ ID NO: 9552 - DNA, 17 bp, Artificial sequence
  Synthesized sequence
ttcgcgcggcgcccgct

SEQ ID NO: 9553 - DNA, 17 bp, Artificial sequence
  Synthesized sequence
gcgtcgcgcagcttgcg

SEQ ID NO: 9554 - DNA, 17 bp, Artificial sequence
  Synthesized sequence
atggaccgccgcgagct

SEQ ID NO: 9555 - DNA, 17 bp, Artificial sequence
  Synthesized sequence
ctggcgcccttcccgcc

SEQ ID NO: 9556 - DNA, 17 bp, Artificial sequence
  Synthesized sequence
gcggaccggcgctggca

SEQ ID NO: 9557 - DNA, 17 bp, Artificial sequence
  Synthesized sequence
gtgggatagcgagtcct

SEQ ID NO: 9558 - DNA, 17 bp, Artificial sequence
  Synthesized sequence
ctggccagctcgctgat

SEQ ID NO: 9559 - DNA, 17 bp, Artificial sequence
  Synthesized sequence
ctggcgcggcgccaggt

SEQ ID NO: 9560 - DNA, 17 bp, Artificial sequence
  Synthesized sequence
gtggcatcgacgtcggc

SEQ ID NO: 9561 - DNA, 17 bp, Artificial sequence
  Synthesized sequence
ctggaacggcatcgtct

SEQ ID NO: 9562 - DNA, 17 bp, Artificial sequence
  Synthesized sequence
cgggaaccggccatgcg

SEQ ID NO: 9563 - DNA, 17 bp, Artificial sequence
  Synthesized sequence
atgacagcgttctcgcg

SEQ ID NO: 9564 - DNA, 17 bp, Artificial sequence
  Synthesized sequence
ccggcgcaggcctcgcc

SEQ ID NO: 9565 - DNA, 17 bp, Artificial sequence
  Synthesized sequence
tcggcgcgccgattacc

SEQ ID NO: 9566 - DNA, 17 bp, Artificial sequence
  Synthesized sequence
atcgcatcgcggtcgcc

SEQ ID NO: 9567 - DNA, 17 bp, Artificial sequence
  Synthesized sequence
ctggccggcgctcggct

SEQ ID NO: 9568 - DNA, 17 bp, Artificial sequence
  Synthesized sequence
acgtcatgacgctggct

SEQ ID NO: 9569 - DNA, 17 bp, Artificial sequence
  Synthesized sequence
ggggcgcggtttccgca

SEQ ID NO: 9570 - DNA, 17 bp, Artificial sequence
  Synthesized sequence
ctggcgcggggttcggc

SEQ ID NO: 9571 - DNA, 17 bp, Artificial sequence
  Synthesized sequence
atggcgcaggcggggcg

SEQ ID NO: 9572 - DNA, 17 bp, Artificial sequence
  Synthesized sequence
atggcgcaggcggggcg

SEQ ID NO: 9573 - DNA, 17 bp, Artificial sequence
  Synthesized sequence
ctgggccaggacttccc

SEQ ID NO: 9574 - DNA, 17 bp, Artificial sequence
  Synthesized sequence
attgcaaaaagttcgcg

SEQ ID NO: 9575 - DNA, 17 bp, Artificial sequence
  Synthesized sequence
caggcccggttgctgga

SEQ ID NO: 9576 - DNA, 17 bp, Artificial sequence
  Synthesized sequence
gctgcccgcgccttgcg

SEQ ID NO: 9577 - DNA, 17 bp, Artificial sequence
  Synthesized sequence
ctggtcaacacctggct

SEQ ID NO: 9578 - DNA, 17 bp, Artificial sequence
  Synthesized sequence
cgcgcccgaatcctgct

SEQ ID NO: 9579 - DNA, 17 bp, Artificial sequence
  Synthesized sequence
gtggacgaggcgctgct

SEQ ID NO: 9580 - DNA, 17 bp, Artificial sequence
  Synthesized sequence
gcggcgagcagttcgct

SEQ ID NO: 9581 - DNA, 17 bp, Artificial sequence
  Synthesized sequence
gtcgcacagcctcggcg

SEQ ID NO: 9582 - DNA, 17 bp, Artificial sequence
  Synthesized sequence
gatgcaggacccgtgca

SEQ ID NO: 9583 - DNA, 17 bp, Artificial sequence
  Synthesized sequence
ttggccaagccccttca

SEQ ID NO: 9584 - DNA, 17 bp, Artificial sequence
  Synthesized sequence
ggggtgcgcaagctgca

SEQ ID NO: 9585 - DNA, 17 bp, Artificial sequence
  Synthesized sequence
aaggcggcggagttgcg

SEQ ID NO: 9586 - DNA, 17 bp, Artificial sequence
  Synthesized sequence
ctggaagtgtatttccg

SEQ ID NO: 9587 - DNA, 17 bp, Artificial sequence
  Synthesized sequence
ctggaagtgtatttccg

SEQ ID NO: 9588 - DNA, 17 bp, Artificial sequence
  Synthesized sequence
ctggtgaccctgctgca

SEQ ID NO: 9589 - DNA, 17 bp, Artificial sequence
  Synthesized sequence
ctggaggtcctgctgct

SEQ ID NO: 9590 - DNA, 17 bp, Artificial sequence
  Synthesized sequence
atggaacacagcatccg

SEQ ID NO: 9591 - DNA, 17 bp, Artificial sequence
  Synthesized sequence
cttgaaccagattcgct

SEQ ID NO: 9592 - DNA, 17 bp, Artificial sequence
  Synthesized sequence
ctggcctggaccgagcg

SEQ ID NO: 9593 - DNA, 17 bp, Artificial sequence
  Synthesized sequence
gtggcaggcgcgtgacg

SEQ ID NO: 9594 - DNA, 17 bp, Artificial sequence
  Synthesized sequence
ccggcacagcaggtccg

SEQ ID NO: 9595 - DNA, 17 bp, Artificial sequence
  Synthesized sequence
tttgcgctatatgtgca

SEQ ID NO: 9596 - DNA, 17 bp, Artificial sequence
  Synthesized sequence
gtggcactccagcacct

SEQ ID NO: 9597 - DNA, 17 bp, Artificial sequence
  Synthesized sequence
gtcgcgccgctggtgcg

SEQ ID NO: 9598 - DNA, 17 bp, Artificial sequence
  Synthesized sequence
ttggctttccgattgac

SEQ ID NO: 9599 - DNA, 17 bp, Artificial sequence
  Synthesized sequence
tggcctcggtgcttgcc

SEQ ID NO: 9600 - DNA, 17 bp, Artificial sequence
  Synthesized sequence
cttctaccccagttgct

SEQ ID NO: 9601 - DNA, 17 bp, Artificial sequence
  Synthesized sequence
ctggactacctgctgcg

SEQ ID NO: 9602 - DNA, 17 bp, Artificial sequence
  Synthesized sequence
caggcatccatcgcgct

SEQ ID NO: 9603 - DNA, 17 bp, Artificial sequence
  Synthesized sequence
atggcgcccatcgcgcc

SEQ ID NO: 9604 - DNA, 17 bp, Artificial sequence
  Synthesized sequence
ctggccccaccattcga

SEQ ID NO: 9605 - DNA, 17 bp, Artificial sequence
  Synthesized sequence
gcggcgcggtgatttcc

SEQ ID NO: 9606 - DNA, 17 bp, Artificial sequence
  Synthesized sequence
ctcgaccgggtgctgca

SEQ ID NO: 9607 - DNA, 17 bp, Artificial sequence
  Synthesized sequence
ctggcctacagcctggt

SEQ ID NO: 9608 - DNA, 17 bp, Artificial sequence
  Synthesized sequence
gtggtcgagctgctgcg

SEQ ID NO: 9609 - DNA, 17 bp, Artificial sequence
  Synthesized sequence
ctgggcctaccactgcc

SEQ ID NO: 9610 - DNA, 17 bp, Artificial sequence
  Synthesized sequence
ccggcgctgggcttcca

SEQ ID NO: 9611 - DNA, 17 bp, Artificial sequence
  Synthesized sequence
ctggcggtagcgctgcc

SEQ ID NO: 9612 - DNA, 17 bp, Artificial sequence
  Synthesized sequence
ctgccatgcggatttcc

SEQ ID NO: 9613 - DNA, 17 bp, Artificial sequence
  Synthesized sequence
ctggcaggttgttgggc

SEQ ID NO: 9614 - DNA, 17 bp, Artificial sequence
  Synthesized sequence
ctgggacctggccggca

SEQ ID NO: 9615 - DNA, 17 bp, Artificial sequence
  Synthesized sequence
aggggactggttctgcc

SEQ ID NO: 9616 - DNA, 17 bp, Artificial sequence
  Synthesized sequence
tgggaacgactgctgaa

SEQ ID NO: 9617 - DNA, 17 bp, Artificial sequence
  Synthesized sequence
gtggtgcgagccatgat

SEQ ID NO: 9618 - DNA, 17 bp, Artificial sequence
  Synthesized sequence
acggcgcagcgctttcg

SEQ ID NO: 9619 - DNA, 17 bp, Artificial sequence
  Synthesized sequence
ttcggaccgacctggca

SEQ ID NO: 9620 - DNA, 17 bp, Artificial sequence
  Synthesized sequence
accgcaccctacctgca

SEQ ID NO: 9621 - DNA, 17 bp, Artificial sequence
  Synthesized sequence
cccgccggacaattgct

SEQ ID NO: 9622 - DNA, 17 bp, Artificial sequence
  Synthesized sequence
ctggccggaaggcttct

SEQ ID NO: 9623 - DNA, 17 bp, Artificial sequence
  Synthesized sequence
ctggccggcgaggtgtt

SEQ ID NO: 9624 - DNA, 17 bp, Artificial sequence
  Synthesized sequence
ttcgcacaaaattcgaa

SEQ ID NO: 9625 - DNA, 17 bp, Artificial sequence
  Synthesized sequence
agggcacgccgctgccc

SEQ ID NO: 9626 - DNA, 17 bp, Artificial sequence
  Synthesized sequence
ctggtgggcaacgtgcg

SEQ ID NO: 9627 - DNA, 17 bp, Artificial sequence
  Synthesized sequence
caggcacaacgcctggc

SEQ ID NO: 9628 - DNA, 17 bp, Artificial sequence
  Synthesized sequence
atggtgcatggcgtgcc

SEQ ID NO: 9629 - DNA, 17 bp, Artificial sequence
  Synthesized sequence
ctggcggcgctcgggct

SEQ ID NO: 9630 - DNA, 17 bp, Artificial sequence
  Synthesized sequence
gtggcctgccagcagcg

SEQ ID NO: 9631 - DNA, 17 bp, Artificial sequence
  Synthesized sequence
gtcgcaggcggatcgcc

SEQ ID NO: 9632 - DNA, 17 bp, Artificial sequence
  Synthesized sequence
ctggcggggctgccgcc

SEQ ID NO: 9633 - DNA, 17 bp, Artificial sequence
  Synthesized sequence
ctggctcaagcgttcga

SEQ ID NO: 9634 - DNA, 17 bp, Artificial sequence
  Synthesized sequence
ctggcccccctggcgcg

SEQ ID NO: 9635 - DNA, 17 bp, Artificial sequence
  Synthesized sequence
gcggcaccggcctggaa

SEQ ID NO: 9636 - DNA, 17 bp, Artificial sequence
  Synthesized sequence
cgggcactggcgatgga

SEQ ID NO: 9637 - DNA, 17 bp, Artificial sequence
  Synthesized sequence
atggtttgcaactggcg

SEQ ID NO: 9638 - DNA, 17 bp, Artificial sequence
  Synthesized sequence
gtgccacgccgcctggc

SEQ ID NO: 9639 - DNA, 17 bp, Artificial sequence
  Synthesized sequence
ccggcacgtacagggcg

SEQ ID NO: 9640 - DNA, 17 bp, Artificial sequence
  Synthesized sequence
atggtcggcatctcgcg

SEQ ID NO: 9641 - DNA, 17 bp, Artificial sequence
  Synthesized sequence
ctggcgaaagggttggg

SEQ ID NO: 9642 - DNA, 17 bp, Artificial sequence
  Synthesized sequence
cgggcacttgtcctgga

SEQ ID NO: 9643 - DNA, 17 bp, Artificial sequence
  Synthesized sequence
gtggccctgacccggcc

SEQ ID NO: 9644 - DNA, 17 bp, Artificial sequence
  Synthesized sequence
gaggaaagcccatggca

SEQ ID NO: 9645 - DNA, 17 bp, Artificial sequence
  Synthesized sequence
ttgaaaaagttcctgca

SEQ ID NO: 9646 - DNA, 17 bp, Artificial sequence
  Synthesized sequence
acggcaacggctatgcg

SEQ ID NO: 9647 - DNA, 17 bp, Artificial sequence
  Synthesized sequence
ctgcccggaacgctgct

SEQ ID NO: 9648 - DNA, 17 bp, Artificial sequence
  Synthesized sequence
gtgctgcgccatctgct

SEQ ID NO: 9649 - DNA, 17 bp, Artificial sequence
  Synthesized sequence
agggcaacgcgatcgcg

SEQ ID NO: 9650 - DNA, 17 bp, Artificial sequence
  Synthesized sequence
gcggcgctggctttcca

SEQ ID NO: 9651 - DNA, 17 bp, Artificial sequence
  Synthesized sequence
tcgcgacgccgattgcc

SEQ ID NO: 9652 - DNA, 17 bp, Artificial sequence
  Synthesized sequence
aaggcaaggatctttga

SEQ ID NO: 9653 - DNA, 17 bp, Artificial sequence
  Synthesized sequence
aaggcaaggatctttga

SEQ ID NO: 9654 - DNA, 17 bp, Artificial sequence
  Synthesized sequence
ctggcaaagcgcttcgc

SEQ ID NO: 9655 - DNA, 17 bp, Artificial sequence
  Synthesized sequence
ctggcaaagcgcttcgc

SEQ ID NO: 9656 - DNA, 17 bp, Artificial sequence
  Synthesized sequence
agggcatgcgcaacgca

SEQ ID NO: 9657 - DNA, 17 bp, Artificial sequence
  Synthesized sequence
agggcatgcgcaacgca

SEQ ID NO: 9658 - DNA, 17 bp, Artificial sequence
  Synthesized sequence
gaggcggcggccttgcc

SEQ ID NO: 9659 - DNA, 17 bp, Artificial sequence
  Synthesized sequence
ctggcgcgtgcggcgcg

SEQ ID NO: 9660 - DNA, 17 bp, Artificial sequence
  Synthesized sequence
ccggcgcgcagcttccc

SEQ ID NO: 9661 - DNA, 17 bp, Artificial sequence
  Synthesized sequence
gctgcacgcggtctgcg

SEQ ID NO: 9662 - DNA, 17 bp, Artificial sequence
  Synthesized sequence
gcggcgcggcgaacgct

SEQ ID NO: 9663 - DNA, 17 bp, Artificial sequence
  Synthesized sequence
atgacatgggacattct

SEQ ID NO: 9664 - DNA, 17 bp, Artificial sequence
  Synthesized sequence
aaggctcggcaggggct

SEQ ID NO: 9665 - DNA, 17 bp, Artificial sequence
  Synthesized sequence
gcggcaaggcttcggcg

SEQ ID NO: 9666 - DNA, 17 bp, Artificial sequence
  Synthesized sequence
caggcgcgccccgggct

SEQ ID NO: 9667 - DNA, 17 bp, Artificial sequence
  Synthesized sequence
atggaatatccccagct

SEQ ID NO: 9668 - DNA, 17 bp, Artificial sequence
  Synthesized sequence
tcggcatccgcctggcg

SEQ ID NO: 9669 - DNA, 17 bp, Artificial sequence
  Synthesized sequence
cagccgcgcggcttgcg

SEQ ID NO: 9670 - DNA, 17 bp, Artificial sequence
  Synthesized sequence
tcggcgcggctctccct

SEQ ID NO: 9671 - DNA, 17 bp, Artificial sequence
  Synthesized sequence
ttggcgcatcagcagcg

SEQ ID NO: 9672 - DNA, 17 bp, Artificial sequence
  Synthesized sequence
gtgcatcggctactgca

SEQ ID NO: 9673 - DNA, 17 bp, Artificial sequence
  Synthesized sequence
ctggtcctcgggttgaa

SEQ ID NO: 9674 - DNA, 17 bp, Artificial sequence
  Synthesized sequence
atggccgagcacctgga

SEQ ID NO: 9675 - DNA, 17 bp, Artificial sequence
  Synthesized sequence
ctgccgcaggccctgcg

SEQ ID NO: 9676 - DNA, 17 bp, Artificial sequence
  Synthesized sequence
ccggcctgaccggtgcg

SEQ ID NO: 9677 - DNA, 17 bp, Artificial sequence
  Synthesized sequence
ctgccacgaacagggcc

SEQ ID NO: 9678 - DNA, 17 bp, Artificial sequence
  Synthesized sequence
gcggaactgggttggca

SEQ ID NO: 9679 - DNA, 17 bp, Artificial sequence
  Synthesized sequence
ctggtcggcggcttcct

SEQ ID NO: 9680 - DNA, 17 bp, Artificial sequence
  Synthesized sequence
gcggccaagggcctgct

SEQ ID NO: 9681 - DNA, 17 bp, Artificial sequence
  Synthesized sequence
ctggcccggcacggcct

SEQ ID NO: 9682 - DNA, 17 bp, Artificial sequence
  Synthesized sequence
atcgctccggcggtgca

SEQ ID NO: 9683 - DNA, 17 bp, Artificial sequence
  Synthesized sequence
cccggacgcgacttgcc

SEQ ID NO: 9684 - DNA, 17 bp, Artificial sequence
  Synthesized sequence
atcgaccgggttctgca

SEQ ID NO: 9685 - DNA, 17 bp, Artificial sequence
  Synthesized sequence
aaggacttaaccttgct

SEQ ID NO: 9686 - DNA, 17 bp, Artificial sequence
  Synthesized sequence
gagatacaggccttgcg

SEQ ID NO: 9687 - DNA, 17 bp, Artificial sequence
  Synthesized sequence
ttggcctggccgacgcc

SEQ ID NO: 9688 - DNA, 17 bp, Artificial sequence
  Synthesized sequence
caggccgactacgtgct

SEQ ID NO: 9689 - DNA, 17 bp, Artificial sequence
  Synthesized sequence
ctggagcgatccgcgca

SEQ ID NO: 9690 - DNA, 17 bp, Artificial sequence
  Synthesized sequence
ctggccgccgggctgcc

SEQ ID NO: 9691 - DNA, 17 bp, Artificial sequence
  Synthesized sequence
ctggcgagtaccgcgca

SEQ ID NO: 9692 - DNA, 17 bp, Artificial sequence
  Synthesized sequence
ctggcaaccgtcctacg

SEQ ID NO: 9693 - DNA, 17 bp, Artificial sequence
  Synthesized sequence
ctggcgctggtggcgcg

SEQ ID NO: 9694 - DNA, 17 bp, Artificial sequence
  Synthesized sequence
ttgggacaccccctacc

SEQ ID NO: 9695 - DNA, 17 bp, Artificial sequence
  Synthesized sequence
ctggtccgcgccatggt

SEQ ID NO: 9696 - DNA, 17 bp, Artificial sequence
  Synthesized sequence
ctcggacatcgatggct

SEQ ID NO: 9697 - DNA, 17 bp, Artificial sequence
  Synthesized sequence
ctggcgccgcgccagcg

SEQ ID NO: 9698 - DNA, 17 bp, Artificial sequence
  Synthesized sequence
cgggtccgcgagctgct

SEQ ID NO: 9699 - DNA, 17 bp, Artificial sequence
  Synthesized sequence
gaggccaggacgttgtt

SEQ ID NO: 9700 - DNA, 17 bp, Artificial sequence
  Synthesized sequence
aagggccaggtcctgca

SEQ ID NO: 9701 - DNA, 17 bp, Artificial sequence
  Synthesized sequence
caggcatgaggagcgca

SEQ ID NO: 9702 - DNA, 17 bp, Artificial sequence
  Synthesized sequence
ctggccagccagtcgaa

SEQ ID NO: 9703 - DNA, 17 bp, Artificial sequence
  Synthesized sequence
tcggcatgcacctggga

SEQ ID NO: 9704 - DNA, 17 bp, Artificial sequence
  Synthesized sequence
atggccagccggtcggt

SEQ ID NO: 9705 - DNA, 17 bp, Artificial sequence
  Synthesized sequence
ctggcggacaggtagcc

SEQ ID NO: 9706 - DNA, 17 bp, Artificial sequence
  Synthesized sequence
aacgcacgcttttcgcc

SEQ ID NO: 9707 - DNA, 17 bp, Artificial sequence
  Synthesized sequence
ttcgtgccgatgttgcg

SEQ ID NO: 9708 - DNA, 17 bp, Artificial sequence
  Synthesized sequence
ccggcacagcggctacg

SEQ ID NO: 9709 - DNA, 17 bp, Artificial sequence
  Synthesized sequence
tcggccctggccctgcg

SEQ ID NO: 9710 - DNA, 17 bp, Artificial sequence
  Synthesized sequence
ctggccctgcgcctggc

SEQ ID NO: 9711 - DNA, 17 bp, Artificial sequence
  Synthesized sequence
atggcgtaggtatcggt

SEQ ID NO: 9712 - DNA, 17 bp, Artificial sequence
  Synthesized sequence
ctggaaagccgctgcct

SEQ ID NO: 9713 - DNA, 17 bp, Artificial sequence
  Synthesized sequence
gcggcactgctgatggg

SEQ ID NO: 9714 - DNA, 17 bp, Artificial sequence
  Synthesized sequence
aaggccgacatgctgca

SEQ ID NO: 9715 - DNA, 17 bp, Artificial sequence
  Synthesized sequence
ctggcgcacccgcttcg

SEQ ID NO: 9716 - DNA, 17 bp, Artificial sequence
  Synthesized sequence
tcggcccggaaggggct

SEQ ID NO: 9717 - DNA, 17 bp, Artificial sequence
  Synthesized sequence
tcggcctgggtatcgcg

SEQ ID NO: 9718 - DNA, 17 bp, Artificial sequence
  Synthesized sequence
attgcgcggagatggcc

SEQ ID NO: 9719 - DNA, 17 bp, Artificial sequence
  Synthesized sequence
ccggcgcgcgggtggcc

SEQ ID NO: 9720 - DNA, 17 bp, Artificial sequence
  Synthesized sequence
ttggctggccgtctgga

SEQ ID NO: 9721 - DNA, 17 bp, Artificial sequence
  Synthesized sequence
ctggcgcgcgcctggac

SEQ ID NO: 9722 - DNA, 17 bp, Artificial sequence
  Synthesized sequence
gtgacccaggccctgcg

SEQ ID NO: 9723 - DNA, 17 bp, Artificial sequence
  Synthesized sequence
ggggctggtcggctgct

SEQ ID NO: 9724 - DNA, 17 bp, Artificial sequence
  Synthesized sequence
atgctgcgcaacgtgct

SEQ ID NO: 9725 - DNA, 17 bp, Artificial sequence
  Synthesized sequence
gttgcagggctacttca

SEQ ID NO: 9726 - DNA, 17 bp, Artificial sequence
  Synthesized sequence
ctggcaggcgcatgacc

SEQ ID NO: 9727 - DNA, 17 bp, Artificial sequence
  Synthesized sequence
cgggcgggccttttcca

SEQ ID NO: 9728 - DNA, 17 bp, Artificial sequence
  Synthesized sequence
ctgggcttctccgtgct

SEQ ID NO: 9729 - DNA, 17 bp, Artificial sequence
  Synthesized sequence
atgggccgcgaccagct

SEQ ID NO: 9730 - DNA, 17 bp, Artificial sequence
  Synthesized sequence
cgggcgacccgcttgcc

SEQ ID NO: 9731 - DNA, 17 bp, Artificial sequence
  Synthesized sequence
ctcgcgcgattttttcc

SEQ ID NO: 9732 - DNA, 17 bp, Artificial sequence
  Synthesized sequence
ctggcagatcggcagcg

SEQ ID NO: 9733 - DNA, 17 bp, Artificial sequence
  Synthesized sequence
gaggtcggcgggttgca

SEQ ID NO: 9734 - DNA, 17 bp, Artificial sequence
  Synthesized sequence
gtggccagtgacctggt

SEQ ID NO: 9735 - DNA, 17 bp, Artificial sequence
  Synthesized sequence
ctggtgcggcggctgaa

SEQ ID NO: 9736 - DNA, 17 bp, Artificial sequence
  Synthesized sequence
ctggagcggcggccgca

SEQ ID NO: 9737 - DNA, 17 bp, Artificial sequence
  Synthesized sequence
tccgaacgcatcctgct

SEQ ID NO: 9738 - DNA, 17 bp, Artificial sequence
  Synthesized sequence
atggcgagctggcggca

SEQ ID NO: 9739 - DNA, 17 bp, Artificial sequence
  Synthesized sequence
ctggcacgcgccagacc

SEQ ID NO: 9740 - DNA, 17 bp, Artificial sequence
  Synthesized sequence
tcggcgtggttctcgcc

SEQ ID NO: 9741 - DNA, 17 bp, Artificial sequence
  Synthesized sequence
cggggacggcgtgggct

SEQ ID NO: 9742 - DNA, 17 bp, Artificial sequence
  Synthesized sequence
atcgtccgcgtactgct

SEQ ID NO: 9743 - DNA, 17 bp, Artificial sequence
  Synthesized sequence
aagccgtgccgtttgct

SEQ ID NO: 9744 - DNA, 17 bp, Artificial sequence
  Synthesized sequence
cagggacggcgtcggct

SEQ ID NO: 9745 - DNA, 17 bp, Artificial sequence
  Synthesized sequence
cgggcactgctgttcga

SEQ ID NO: 9746 - DNA, 17 bp, Artificial sequence
  Synthesized sequence
gtggtccgcgccgcgct

SEQ ID NO: 9747 - DNA, 17 bp, Artificial sequence
  Synthesized sequence
ctggccaaggccgcgct

SEQ ID NO: 9748 - DNA, 17 bp, Artificial sequence
  Synthesized sequence
gctgcacggcggtcgcc

SEQ ID NO: 9749 - DNA, 17 bp, Artificial sequence
  Synthesized sequence
ctcgaccaccagttgcg

SEQ ID NO: 9750 - DNA, 17 bp, Artificial sequence
  Synthesized sequence
acagcagcgctgttgcg

SEQ ID NO: 9751 - DNA, 17 bp, Artificial sequence
  Synthesized sequence
ctggcggtgctcgggct

SEQ ID NO: 9752 - DNA, 17 bp, Artificial sequence
  Synthesized sequence
ctggcgcagttcttctc

SEQ ID NO: 9753 - DNA, 17 bp, Artificial sequence
  Synthesized sequence
aaggcatcgtcgtggcc

SEQ ID NO: 9754 - DNA, 17 bp, Artificial sequence
  Synthesized sequence
caggctggcacctcgct

SEQ ID NO: 9755 - DNA, 17 bp, Artificial sequence
  Synthesized sequence
ctggtggacgaggtgct

SEQ ID NO: 9756 - DNA, 17 bp, Artificial sequence
  Synthesized sequence
ccgccagagccgttgcc

SEQ ID NO: 9757 - DNA, 17 bp, Artificial sequence
  Synthesized sequence
agggcgtggccctcgcg

SEQ ID NO: 9758 - DNA, 17 bp, Artificial sequence
  Synthesized sequence
gtggaaagcggcctggt

SEQ ID NO: 9759 - DNA, 17 bp, Artificial sequence
  Synthesized sequence
agggcccaaggctcgcg

SEQ ID NO: 9760 - DNA, 17 bp, Artificial sequence
  Synthesized sequence
atgtcccggccgttccg

SEQ ID NO: 9761 - DNA, 17 bp, Artificial sequence
  Synthesized sequence
tgggcggtaaatttgcc

SEQ ID NO: 9762 - DNA, 17 bp, Artificial sequence
  Synthesized sequence
ctggttcggtccgtcct

SEQ ID NO: 9763 - DNA, 17 bp, Artificial sequence
  Synthesized sequence
aaggcctggactatgcg

SEQ ID NO: 9764 - DNA, 17 bp, Artificial sequence
  Synthesized sequence
tggggaggcaacttcct

SEQ ID NO: 9765 - DNA, 17 bp, Artificial sequence
  Synthesized sequence
cggccatgcccagtgct

SEQ ID NO: 9766 - DNA, 17 bp, Artificial sequence
  Synthesized sequence
gatgcgagcctgttgca

SEQ ID NO: 9767 - DNA, 17 bp, Artificial sequence
  Synthesized sequence
gatgcgagcctgttgca

SEQ ID NO: 9768 - DNA, 17 bp, Artificial sequence
  Synthesized sequence
tcagcaccgccattgat

SEQ ID NO: 9769 - DNA, 17 bp, Artificial sequence
  Synthesized sequence
ctggcgggcggccggca

SEQ ID NO: 9770 - DNA, 17 bp, Artificial sequence
  Synthesized sequence
aacgcaagggccgtgct

SEQ ID NO: 9771 - DNA, 17 bp, Artificial sequence
  Synthesized sequence
aacgcaagggccgtgct

SEQ ID NO: 9772 - DNA, 17 bp, Artificial sequence
  Synthesized sequence
gctgcccgcgccttgcg

SEQ ID NO: 9773 - DNA, 17 bp, Artificial sequence
  Synthesized sequence
attgcccgaagcttccg

SEQ ID NO: 9774 - DNA, 17 bp, Artificial sequence
  Synthesized sequence
ctggtcgccgcgttgcg

SEQ ID NO: 9775 - DNA, 17 bp, Artificial sequence
  Synthesized sequence
acggcaaataattagcg

SEQ ID NO: 9776 - DNA, 17 bp, Artificial sequence
  Synthesized sequence
atggcgccgcaagggcg

SEQ ID NO: 9777 - DNA, 17 bp, Artificial sequence
  Synthesized sequence
tcggcggatatcgtgct

SEQ ID NO: 9778 - DNA, 17 bp, Artificial sequence
  Synthesized sequence
ttgccgagcgacatgct

SEQ ID NO: 9779 - DNA, 17 bp, Artificial sequence
  Synthesized sequence
ctggcgctgttgctgtg

SEQ ID NO: 9780 - DNA, 17 bp, Artificial sequence
  Synthesized sequence
ttggcgaggccccggcg

SEQ ID NO: 9781 - DNA, 17 bp, Artificial sequence
  Synthesized sequence
gaggcctggttcttccg

SEQ ID NO: 9782 - DNA, 17 bp, Artificial sequence
  Synthesized sequence
ccggcagtgaagtggcg

SEQ ID NO: 9783 - DNA, 17 bp, Artificial sequence
  Synthesized sequence
ctggcgggccgcctcca

SEQ ID NO: 9784 - DNA, 17 bp, Artificial sequence
  Synthesized sequence
ctgcaactgaagttcct

SEQ ID NO: 9785 - DNA, 17 bp, Artificial sequence
  Synthesized sequence
attgaagggaactcgca

SEQ ID NO: 9786 - DNA, 17 bp, Artificial sequence
  Synthesized sequence
atgggcaagtcctggct

SEQ ID NO: 9787 - DNA, 17 bp, Artificial sequence
  Synthesized sequence
gcggcaccctcggcgca

SEQ ID NO: 9788 - DNA, 17 bp, Artificial sequence
  Synthesized sequence
ctggccctgctggtggc

SEQ ID NO: 9789 - DNA, 17 bp, Artificial sequence
  Synthesized sequence
ctggtaccgcaactggc

SEQ ID NO: 9790 - DNA, 17 bp, Artificial sequence
  Synthesized sequence
ggagcgcggctgatgct

SEQ ID NO: 9791 - DNA, 17 bp, Artificial sequence
  Synthesized sequence
ctggcgagggcgctgaa

SEQ ID NO: 9792 - DNA, 17 bp, Artificial sequence
  Synthesized sequence
ctggcctgaaccgggcg

SEQ ID NO: 9793 - DNA, 17 bp, Artificial sequence
  Synthesized sequence
caggcatggcggtggga

SEQ ID NO: 9794 - DNA, 17 bp, Artificial sequence
  Synthesized sequence
gtggtcctggcggtgcc

SEQ ID NO: 9795 - DNA, 17 bp, Artificial sequence
  Synthesized sequence
ctggcggtgatcctgat

SEQ ID NO: 9796 - DNA, 17 bp, Artificial sequence
  Synthesized sequence
gttgcagggcgagcgct

SEQ ID NO: 9797 - DNA, 17 bp, Artificial sequence
  Synthesized sequence
ctgacccggctgccgct

SEQ ID NO: 9798 - DNA, 17 bp, Artificial sequence
  Synthesized sequence
ctgttcggcccgttgct

SEQ ID NO: 9799 - DNA, 17 bp, Artificial sequence
  Synthesized sequence
ctcgcgcaacctctgcc

SEQ ID NO: 9800 - DNA, 17 bp, Artificial sequence
  Synthesized sequence
tcggcaatacattcgcc

SEQ ID NO: 9801 - DNA, 17 bp, Artificial sequence
  Synthesized sequence
ctggccgagcaggcgca

SEQ ID NO: 9802 - DNA, 17 bp, Artificial sequence
  Synthesized sequence
cgggtccgctcgctgct

SEQ ID NO: 9803 - DNA, 17 bp, Artificial sequence
  Synthesized sequence
atcggcagccagttgct

SEQ ID NO: 9804 - DNA, 17 bp, Artificial sequence
  Synthesized sequence
gaggcctgcatgatgcg

SEQ ID NO: 9805 - DNA, 17 bp, Artificial sequence
  Synthesized sequence
ctggcgcaagcagcgcg

SEQ ID NO: 9806 - DNA, 17 bp, Artificial sequence
  Synthesized sequence
ctggcccgtcgctgggc

SEQ ID NO: 9807 - DNA, 17 bp, Artificial sequence
  Synthesized sequence
ctggcgctgatgctggc

SEQ ID NO: 9808 - DNA, 17 bp, Artificial sequence
  Synthesized sequence
gtggaaagcggcctgaa

SEQ ID NO: 9809 - DNA, 17 bp, Artificial sequence
  Synthesized sequence
tgggcccctgcaatgct

SEQ ID NO: 9810 - DNA, 17 bp, Artificial sequence
  Synthesized sequence
gtggtacctgaactact

SEQ ID NO: 9811 - DNA, 17 bp, Artificial sequence
  Synthesized sequence
atcgccttgctgctgct

SEQ ID NO: 9812 - DNA, 17 bp, Artificial sequence
  Synthesized sequence
ctggaacaaggccggcc

SEQ ID NO: 9813 - DNA, 17 bp, Artificial sequence
  Synthesized sequence
gtggccgcgagcttgac

SEQ ID NO: 9814 - DNA, 17 bp, Artificial sequence
  Synthesized sequence
ctggtggcggccctgct

SEQ ID NO: 9815 - DNA, 17 bp, Artificial sequence
  Synthesized sequence
atggcgccgcgcgagcc

SEQ ID NO: 9816 - DNA, 17 bp, Artificial sequence
  Synthesized sequence
gtggccagcggcctgtt

SEQ ID NO: 9817 - DNA, 17 bp, Artificial sequence
  Synthesized sequence
ctgtcaggcgcttggcg

SEQ ID NO: 9818 - DNA, 17 bp, Artificial sequence
  Synthesized sequence
ttgccctgggcgtcgct

SEQ ID NO: 9819 - DNA, 17 bp, Artificial sequence
  Synthesized sequence
aaggccttcgtcgtgct

SEQ ID NO: 9820 - DNA, 17 bp, Artificial sequence
  Synthesized sequence
gtggcgggcggcgcgca

SEQ ID NO: 9821 - DNA, 17 bp, Artificial sequence
  Synthesized sequence
gttgcgggcgttctgca

SEQ ID NO: 9822 - DNA, 17 bp, Artificial sequence
  Synthesized sequence
tcggcgccgctgtagcc

SEQ ID NO: 9823 - DNA, 17 bp, Artificial sequence
  Synthesized sequence
taggcgcgtacgtcgcc

SEQ ID NO: 9824 - DNA, 17 bp, Artificial sequence
  Synthesized sequence
atggaaccaaacaagcg

SEQ ID NO: 9825 - DNA, 17 bp, Artificial sequence
  Synthesized sequence
gcgggtagtcgcttgca

SEQ ID NO: 9826 - DNA, 17 bp, Artificial sequence
  Synthesized sequence
ctgtcactgctttcgga

SEQ ID NO: 9827 - DNA, 17 bp, Artificial sequence
  Synthesized sequence
atggaccccaaggtgcg

SEQ ID NO: 9828 - DNA, 17 bp, Artificial sequence
  Synthesized sequence
ttggcagggcgaagact

SEQ ID NO: 9829 - DNA, 17 bp, Artificial sequence
  Synthesized sequence
gtgggcggttgtctgct

SEQ ID NO: 9830 - DNA, 17 bp, Artificial sequence
  Synthesized sequence
atggccgcacagtagcc

SEQ ID NO: 9831 - DNA, 17 bp, Artificial sequence
  Synthesized sequence
ccggctcgacttcttct

SEQ ID NO: 9832 - DNA, 17 bp, Artificial sequence
  Synthesized sequence
ctggaactcccgtccct

SEQ ID NO: 9833 - DNA, 17 bp, Artificial sequence
  Synthesized sequence
atcgcccgcctgccgct

SEQ ID NO: 9834 - DNA, 17 bp, Artificial sequence
  Synthesized sequence
ctgccccagccagtgcc

SEQ ID NO: 9835 - DNA, 17 bp, Artificial sequence
  Synthesized sequence
ttttcaagaccgttgcc

SEQ ID NO: 9836 - DNA, 17 bp, Artificial sequence
  Synthesized sequence
ccggccagcatcctgcg

SEQ ID NO: 9837 - DNA, 17 bp, Artificial sequence
  Synthesized sequence
ccggccagcatcctgcg

SEQ ID NO: 9838 - DNA, 17 bp, Artificial sequence
  Synthesized sequence
ctgggacgaggaatggc

SEQ ID NO: 9839 - DNA, 17 bp, Artificial sequence
  Synthesized sequence
gaggcctggaagctgcg

SEQ ID NO: 9840 - DNA, 17 bp, Artificial sequence
  Synthesized sequence
ctggccagcgccctgga

SEQ ID NO: 9841 - DNA, 17 bp, Artificial sequence
  Synthesized sequence
ctggagcgcttcgagca

SEQ ID NO: 9842 - DNA, 17 bp, Artificial sequence
  Synthesized sequence
caggcccgcttcgagca

SEQ ID NO: 9843 - DNA, 17 bp, Artificial sequence
  Synthesized sequence
ctggaacgaagttgtcc

SEQ ID NO: 9844 - DNA, 17 bp, Artificial sequence
  Synthesized sequence
ccggccggggtttttca

SEQ ID NO: 9845 - DNA, 17 bp, Artificial sequence
  Synthesized sequence
caggccctgcgcctgcc

SEQ ID NO: 9846 - DNA, 17 bp, Artificial sequence
  Synthesized sequence
ctggtctcggcgctgct

SEQ ID NO: 9847 - DNA, 17 bp, Artificial sequence
  Synthesized sequence
tcggcgcacccttcgcc

SEQ ID NO: 9848 - DNA, 17 bp, Artificial sequence
  Synthesized sequence
ctggcgccatcatggtt

SEQ ID NO: 9849 - DNA, 17 bp, Artificial sequence
  Synthesized sequence
acggcctggccctcgcc

SEQ ID NO: 9850 - DNA, 17 bp, Artificial sequence
  Synthesized sequence
gtgccatcgccatcgcc

SEQ ID NO: 9851 - DNA, 17 bp, Artificial sequence
  Synthesized sequence
gtggtaccacgcctggg

SEQ ID NO: 9852 - DNA, 17 bp, Artificial sequence
  Synthesized sequence
tgggcgcagccctttcc

SEQ ID NO: 9853 - DNA, 17 bp, Artificial sequence
  Synthesized sequence
ccggcctggccctcgcc

SEQ ID NO: 9854 - DNA, 17 bp, Artificial sequence
  Synthesized sequence
caggccggcgattcgct

SEQ ID NO: 9855 - DNA, 17 bp, Artificial sequence
  Synthesized sequence
ctggatcggcaacagca

SEQ ID NO: 9856 - DNA, 17 bp, Artificial sequence
  Synthesized sequence
ctggccgagcatctgta

SEQ ID NO: 9857 - DNA, 17 bp, Artificial sequence
  Synthesized sequence
gtgggctgggactcgcg

SEQ ID NO: 9858 - DNA, 17 bp, Artificial sequence
  Synthesized sequence
gaggcgctgaagctgcg

SEQ ID NO: 9859 - DNA, 17 bp, Artificial sequence
  Synthesized sequence
tcagcacgccattggcc

SEQ ID NO: 9860 - DNA, 17 bp, Artificial sequence
  Synthesized sequence
ttgcaccagcggttgcg

SEQ ID NO: 9861 - DNA, 17 bp, Artificial sequence
  Synthesized sequence
ctggagcacaactttcc

SEQ ID NO: 9862 - DNA, 17 bp, Artificial sequence
  Synthesized sequence
aaggacagtcggttgct

SEQ ID NO: 9863 - DNA, 17 bp, Artificial sequence
  Synthesized sequence
tgggagcgttggttgcc

SEQ ID NO: 9864 - DNA, 17 bp, Artificial sequence
  Synthesized sequence
gaggtacagggttggcg

SEQ ID NO: 9865 - DNA, 17 bp, Artificial sequence
  Synthesized sequence
gtcggccgactgctgca

SEQ ID NO: 9866 - DNA, 17 bp, Artificial sequence
  Synthesized sequence
tcgtcggggccattgct

SEQ ID NO: 9867 - DNA, 17 bp, Artificial sequence
  Synthesized sequence
ttggaaccctgctggga

SEQ ID NO: 9868 - DNA, 17 bp, Artificial sequence
  Synthesized sequence
caggcagcgcaatggcg

SEQ ID NO: 9869 - DNA, 17 bp, Artificial sequence
  Synthesized sequence
atggaaaacgtcgggct

SEQ ID NO: 9870 - DNA, 17 bp, Artificial sequence
  Synthesized sequence
gtcgcggaacacctgct

SEQ ID NO: 9871 - DNA, 17 bp, Artificial sequence
  Synthesized sequence
gtggcagccaccaggcc

SEQ ID NO: 9872 - DNA, 17 bp, Artificial sequence
  Synthesized sequence
gtggcagcgcgactggg

SEQ ID NO: 9873 - DNA, 17 bp, Artificial sequence
  Synthesized sequence
gtggctggagttcttca

SEQ ID NO: 9874 - DNA, 17 bp, Artificial sequence
  Synthesized sequence
atggccgccgcggtgcg

SEQ ID NO: 9875 - DNA, 17 bp, Artificial sequence
  Synthesized sequence
atggatcgccccgcgca

SEQ ID NO: 9876 - DNA, 17 bp, Artificial sequence
  Synthesized sequence
atggccggcatcccgcg

SEQ ID NO: 9877 - DNA, 17 bp, Artificial sequence
  Synthesized sequence
aaggcagcccgctggcg

SEQ ID NO: 9878 - DNA, 17 bp, Artificial sequence
  Synthesized sequence
atggagcgacattcgat

SEQ ID NO: 9879 - DNA, 17 bp, Artificial sequence
  Synthesized sequence
ctggcgggtgtccggca

SEQ ID NO: 9880 - DNA, 17 bp, Artificial sequence
  Synthesized sequence
ccggcctgacctatgcg

SEQ ID NO: 9881 - DNA, 17 bp, Artificial sequence
  Synthesized sequence
caggccagcttcctgcg

SEQ ID NO: 9882 - DNA, 17 bp, Artificial sequence
  Synthesized sequence
gatgaactggccttgca

SEQ ID NO: 9883 - DNA, 17 bp, Artificial sequence
  Synthesized sequence
ctggaacttcatctaca

SEQ ID NO: 9884 - DNA, 17 bp, Artificial sequence
  Synthesized sequence
gtaggacgggcttcgcg

SEQ ID NO: 9885 - DNA, 17 bp, Artificial sequence
  Synthesized sequence
ctgaatcgggcgttgcc

SEQ ID NO: 9886 - DNA, 17 bp, Artificial sequence
  Synthesized sequence
aaggaaagccccttcca

SEQ ID NO: 9887 - DNA, 17 bp, Artificial sequence
  Synthesized sequence
aaggggctttccttgca

SEQ ID NO: 9888 - DNA, 17 bp, Artificial sequence
  Synthesized sequence
ctggctggccaactcct

SEQ ID NO: 9889 - DNA, 17 bp, Artificial sequence
  Synthesized sequence
gtggtcggtctcatgcc

SEQ ID NO: 9890 - DNA, 17 bp, Artificial sequence
  Synthesized sequence
ccggaaagcgcggtgct

SEQ ID NO: 9891 - DNA, 17 bp, Artificial sequence
  Synthesized sequence
tgggaatgacctctgcg

SEQ ID NO: 9892 - DNA, 17 bp, Artificial sequence
  Synthesized sequence
atggcatcggcttcgac

SEQ ID NO: 9893 - DNA, 17 bp, Artificial sequence
  Synthesized sequence
acggaggggattttgcg

SEQ ID NO: 9894 - DNA, 17 bp, Artificial sequence
  Synthesized sequence
acggcctcggtttcgct

SEQ ID NO: 9895 - DNA, 17 bp, Artificial sequence
  Synthesized sequence
tcggcctgtgcctggct

SEQ ID NO: 9896 - DNA, 17 bp, Artificial sequence
  Synthesized sequence
ctggctgagcatgcgct

SEQ ID NO: 9897 - DNA, 17 bp, Artificial sequence
  Synthesized sequence
atggcaggggtgctcat

SEQ ID NO: 9898 - DNA, 17 bp, Artificial sequence
  Synthesized sequence
gaggcccggcgcaagct

SEQ ID NO: 9899 - DNA, 17 bp, Artificial sequence
  Synthesized sequence
atggcatcctcgatgtg

SEQ ID NO: 9900 - DNA, 17 bp, Artificial sequence
  Synthesized sequence
cgggcactacgttcgat

SEQ ID NO: 9901 - DNA, 17 bp, Artificial sequence
  Synthesized sequence
ttgacgtgcccgtagct

SEQ ID NO: 9902 - DNA, 17 bp, Artificial sequence
  Synthesized sequence
ctggtgcccagcctgcc

SEQ ID NO: 9903 - DNA, 17 bp, Artificial sequence
  Synthesized sequence
ctcgaactgctgctgcg

SEQ ID NO: 9904 - DNA, 17 bp, Artificial sequence
  Synthesized sequence
ctggggcacgtcttccc

SEQ ID NO: 9905 - DNA, 17 bp, Artificial sequence
  Synthesized sequence
ctgtcatccgcgttaca

SEQ ID NO: 9906 - DNA, 17 bp, Artificial sequence
  Synthesized sequence
ttcgccgaactggtgct

SEQ ID NO: 9907 - DNA, 17 bp, Artificial sequence
  Synthesized sequence
gaggtacgggccgagct

SEQ ID NO: 9908 - DNA, 17 bp, Artificial sequence
  Synthesized sequence
ctcggatagagcgtgca

SEQ ID NO: 9909 - DNA, 17 bp, Artificial sequence
  Synthesized sequence
ccggcgcggaccatgat

SEQ ID NO: 9910 - DNA, 17 bp, Artificial sequence
  Synthesized sequence
ctgggcctgggcctgcg

SEQ ID NO: 9911 - DNA, 17 bp, Artificial sequence
  Synthesized sequence
ctggcatccacgcttcg

SEQ ID NO: 9912 - DNA, 17 bp, Artificial sequence
  Synthesized sequence
gtggtcggcaatttcca

SEQ ID NO: 9913 - DNA, 17 bp, Artificial sequence
  Synthesized sequence
gagggaggaacatggct

SEQ ID NO: 9914 - DNA, 17 bp, Artificial sequence
  Synthesized sequence
ggggtactcgggttgtt

SEQ ID NO: 9915 - DNA, 17 bp, Artificial sequence
  Synthesized sequence
ctcgcgggccaactgca

SEQ ID NO: 9916 - DNA, 17 bp, Artificial sequence
  Synthesized sequence
ctggagaggcaactgcc

SEQ ID NO: 9917 - DNA, 17 bp, Artificial sequence
  Synthesized sequence
aggtccgggaaattgct

SEQ ID NO: 9918 - DNA, 17 bp, Artificial sequence
  Synthesized sequence
gttgctcggcttgcgct

SEQ ID NO: 9919 - DNA, 17 bp, Artificial sequence
  Synthesized sequence
ctgggtatccagttgcc

SEQ ID NO: 9920 - DNA, 17 bp, Artificial sequence
  Synthesized sequence
ccggtagacgccctgct

SEQ ID NO: 9921 - DNA, 17 bp, Artificial sequence
  Synthesized sequence
ttggctgggggccagca

SEQ ID NO: 9922 - DNA, 17 bp, Artificial sequence
  Synthesized sequence
tcggccaggctggtgcc

SEQ ID NO: 9923 - DNA, 17 bp, Artificial sequence
  Synthesized sequence
gtcggccgtctcatgct

SEQ ID NO: 9924 - DNA, 17 bp, Artificial sequence
  Synthesized sequence
ctggcggaagaattccg

SEQ ID NO: 9925 - DNA, 17 bp, Artificial sequence
  Synthesized sequence
ctggctcttgcccagct

SEQ ID NO: 9926 - DNA, 17 bp, Artificial sequence
  Synthesized sequence
gtggtgcgttcgtagcc

SEQ ID NO: 9927 - DNA, 17 bp, Artificial sequence
  Synthesized sequence
ctggtcggcggcttcct

SEQ ID NO: 9928 - DNA, 17 bp, Artificial sequence
  Synthesized sequence
aagggccaactgctgct

SEQ ID NO: 9929 - DNA, 17 bp, Artificial sequence
  Synthesized sequence
atgaccctcggcatgct

SEQ ID NO: 9930 - DNA, 17 bp, Artificial sequence
  Synthesized sequence
caggcccgggttctggt

SEQ ID NO: 9931 - DNA, 17 bp, Artificial sequence
  Synthesized sequence
gcggaacaatcctcgcc

SEQ ID NO: 9932 - DNA, 17 bp, Artificial sequence
  Synthesized sequence
aaagcccagcaattgcc

SEQ ID NO: 9933 - DNA, 17 bp, Artificial sequence
  Synthesized sequence
aaagcccagcaattgcc

SEQ ID NO: 9934 - DNA, 17 bp, Artificial sequence
  Synthesized sequence
ctggaaccggtgctgag

SEQ ID NO: 9935 - DNA, 17 bp, Artificial sequence
  Synthesized sequence
gcggcagcgccatggcc

SEQ ID NO: 9936 - DNA, 17 bp, Artificial sequence
  Synthesized sequence
ctggaactgcccgagcc

SEQ ID NO: 9937 - DNA, 17 bp, Artificial sequence
  Synthesized sequence
ctggaactgaacctggc

SEQ ID NO: 9938 - DNA, 17 bp, Artificial sequence
  Synthesized sequence
ctggctggacaagtcct

SEQ ID NO: 9939 - DNA, 17 bp, Artificial sequence
  Synthesized sequence
ctggcatcggcctgggc

SEQ ID NO: 9940 - DNA, 17 bp, Artificial sequence
  Synthesized sequence
gtcgcccgcagttcgcg

SEQ ID NO: 9941 - DNA, 17 bp, Artificial sequence
  Synthesized sequence
ctggcgccacggtgcct

SEQ ID NO: 9942 - DNA, 17 bp, Artificial sequence
  Synthesized sequence
ctggctggcgtagggca

SEQ ID NO: 9943 - DNA, 17 bp, Artificial sequence
  Synthesized sequence
actgcacggtgctggcc

SEQ ID NO: 9944 - DNA, 17 bp, Artificial sequence
  Synthesized sequence
cgggcgcggccacggct

SEQ ID NO: 9945 - DNA, 17 bp, Artificial sequence
  Synthesized sequence
gtggatcgcagcccgct

SEQ ID NO: 9946 - DNA, 17 bp, Artificial sequence
  Synthesized sequence
acggcagcggcctggcg

SEQ ID NO: 9947 - DNA, 17 bp, Artificial sequence
  Synthesized sequence
caggcgcggcccgcgca

SEQ ID NO: 9948 - DNA, 17 bp, Artificial sequence
  Synthesized sequence
gtggtacccagcttcaa

SEQ ID NO: 9949 - DNA, 17 bp, Artificial sequence
  Synthesized sequence
gtggaagaattgctgat

SEQ ID NO: 9950 - DNA, 17 bp, Artificial sequence
  Synthesized sequence
atggcgggtgtgcggca

SEQ ID NO: 9951 - DNA, 17 bp, Artificial sequence
  Synthesized sequence
ctggcagggcctgctct

SEQ ID NO: 9952 - DNA, 17 bp, Artificial sequence
  Synthesized sequence
gcggccgacctggtgca

SEQ ID NO: 9953 - DNA, 17 bp, Artificial sequence
  Synthesized sequence
tcggcctggccgctgcc

SEQ ID NO: 9954 - DNA, 17 bp, Artificial sequence
  Synthesized sequence
ccggcacggctagcgtt

SEQ ID NO: 9955 - DNA, 17 bp, Artificial sequence
  Synthesized sequence
tgggcatctccggtgcc

SEQ ID NO: 9956 - DNA, 17 bp, Artificial sequence
  Synthesized sequence
ctggtagagaaactgaa

SEQ ID NO: 9957 - DNA, 17 bp, Artificial sequence
  Synthesized sequence
gtcggatgttccgtgca

SEQ ID NO: 9958 - DNA, 17 bp, Artificial sequence
  Synthesized sequence
ccggcgcgcgcattgag

SEQ ID NO: 9959 - DNA, 17 bp, Artificial sequence
  Synthesized sequence
ctggccggggcgctgaa

SEQ ID NO: 9960 - DNA, 17 bp, Artificial sequence
  Synthesized sequence
gtggtgccgggcatgcc

SEQ ID NO: 9961 - DNA, 17 bp, Artificial sequence
  Synthesized sequence
atggcctcgctggtgga

SEQ ID NO: 9962 - DNA, 17 bp, Artificial sequence
  Synthesized sequence
cccggacgaaggttgcg

SEQ ID NO: 9963 - DNA, 17 bp, Artificial sequence
  Synthesized sequence
ctgggtcgcctggggca

SEQ ID NO: 9964 - DNA, 17 bp, Artificial sequence
  Synthesized sequence
ctgggccagattccgct

SEQ ID NO: 9965 - DNA, 17 bp, Artificial sequence
  Synthesized sequence
atgacccgcgagctgcc

SEQ ID NO: 9966 - DNA, 17 bp, Artificial sequence
  Synthesized sequence
gtggcgccgggcttcat

SEQ ID NO: 9967 - DNA, 17 bp, Artificial sequence
  Synthesized sequence
ctggcgcgttatctccg

SEQ ID NO: 9968 - DNA, 17 bp, Artificial sequence
  Synthesized sequence
ctggtcagttgctcgca

SEQ ID NO: 9969 - DNA, 17 bp, Artificial sequence
  Synthesized sequence
ggggcatggctggagcg

SEQ ID NO: 9970 - DNA, 17 bp, Artificial sequence
  Synthesized sequence
gtggacgagatgtggca

SEQ ID NO: 9971 - DNA, 17 bp, Artificial sequence
  Synthesized sequence
ctggaactctcggtgga

SEQ ID NO: 9972 - DNA, 17 bp, Artificial sequence
  Synthesized sequence
gtcgccttcgtgttgcg

SEQ ID NO: 9973 - DNA, 17 bp, Artificial sequence
  Synthesized sequence
atgggaggaaccgttca

SEQ ID NO: 9974 - DNA, 17 bp, Artificial sequence
  Synthesized sequence
gtggatataggcttgcg

SEQ ID NO: 9975 - DNA, 17 bp, Artificial sequence
  Synthesized sequence
caggcgcccagcttgta

SEQ ID NO: 9976 - DNA, 17 bp, Artificial sequence
  Synthesized sequence
agggcacggtgatcggg

SEQ ID NO: 9977 - DNA, 17 bp, Artificial sequence
  Synthesized sequence
atggaaaagaccatgat

SEQ ID NO: 9978 - DNA, 17 bp, Artificial sequence
  Synthesized sequence
ccagcacgcccagtgcc

SEQ ID NO: 9979 - DNA, 17 bp, Artificial sequence
  Synthesized sequence
tcggcaccgagttcgaa

SEQ ID NO: 9980 - DNA, 17 bp, Artificial sequence
  Synthesized sequence
tcggctcgggcttttcc

SEQ ID NO: 9981 - DNA, 17 bp, Artificial sequence
  Synthesized sequence
atggccggctcgctgtt

SEQ ID NO: 9982 - DNA, 17 bp, Artificial sequence
  Synthesized sequence
atggccaacccgccgct

SEQ ID NO: 9983 - DNA, 17 bp, Artificial sequence
  Synthesized sequence
atgccctggtattggca

SEQ ID NO: 9984 - DNA, 17 bp, Artificial sequence
  Synthesized sequence
gcgacacggaaatggcc

SEQ ID NO: 9985 - DNA, 17 bp, Artificial sequence
  Synthesized sequence
tcggctcccgtttttca

SEQ ID NO: 9986 - DNA, 17 bp, Artificial sequence
  Synthesized sequence
cgggctcccgtttttca

SEQ ID NO: 9987 - DNA, 17 bp, Artificial sequence
  Synthesized sequence
ataggacttttcatgca

SEQ ID NO: 9988 - DNA, 17 bp, Artificial sequence
  Synthesized sequence
ctggcgacgatccagct

SEQ ID NO: 9989 - DNA, 17 bp, Artificial sequence
  Synthesized sequence
caggcctacgaagtgct

SEQ ID NO: 9990 - DNA, 17 bp, Artificial sequence
  Synthesized sequence
cgggcagtggaactgcg

SEQ ID NO: 9991 - DNA, 17 bp, Artificial sequence
  Synthesized sequence
ctgcgaccgatcctgcc

SEQ ID NO: 9992 - DNA, 17 bp, Artificial sequence
  Synthesized sequence
ctgggaggagacgttca

SEQ ID NO: 9993 - DNA, 17 bp, Artificial sequence
  Synthesized sequence
gtggaaagcctgttcgt

SEQ ID NO: 9994 - DNA, 17 bp, Artificial sequence
  Synthesized sequence
gtggacgacggcctgct

SEQ ID NO: 9995 - DNA, 17 bp, Artificial sequence
  Synthesized sequence
cgggcacgccgatcgtg

SEQ ID NO: 9996 - DNA, 17 bp, Artificial sequence
  Synthesized sequence
agggcctggcctatgcc

SEQ ID NO: 9997 - DNA, 17 bp, Artificial sequence
  Synthesized sequence
ctggccggcggcaagct

SEQ ID NO: 9998 - DNA, 17 bp, Artificial sequence
  Synthesized sequence
gtggaacaggccgtccg

SEQ ID NO: 9999 - DNA, 17 bp, Artificial sequence
  Synthesized sequence
ctggtctgctgcctgcc

SEQ ID NO: 10000 - protein, 1431 aa, Escherichia coli K-12
MKQGLQLRLSQQLAMTPQLQQAIRLLQLSTLELQQELQQALESNPLLEQIDTHEEIDTRETQDSETLDTADALEQKEMPEELPLDASWDTIYTAGTPSAPAVTYIDDELPVYQGETTQTLQDYLMWQVELTPFSDTDRAIATSIVDAVDETGYLTVPLEDILESIGDEEIDIDEVEAVLKRIQRFDPVGVAAKDLRDCLLIQLSQFDKTTPWLEEARLIISDHLDLLANHDFRTLMRVTRLKEDVLKEAVNLIQSLDPRPGQSIQTGEPEYVIPDVLVRKHNGHWTVELNSDSIPRLQINQHYASMCNNARNDGDSQFIRSNLQDAKWLIKSLESRNDTLLRVSRCIVEQQQAFFEQGEEYMKPMVLADIAQAVEMHESTISRVTTQKYLHSPRGIFELKYFFSSHVNTEGGGEASSTAIRALVKKLIAAENPAKPLSDSKLTSLLSEQGIMVARRTVAKYRESLSIPPSNQRKQLVMKQGLQLRLSQQLAMTPQLQQAIRLLQLSTLELQQELQQALESNPLLEQIDTHEEIDTRETQDSETLDTADALEQKEMPEELPLDASWDTIYTAGTPSAPAVTYIDDELPVYQGETTQTLQDYLMWQVELTPFSDTDRAIATSIVDAVDETGYLTVPLEDILESIGDEEIDIDEVEAVLKRIQRFDPVGVAAKDLRDCLLIQLSQFDKTTPWLEEARLIISDHLDLLANHDFRTLMRVTRLKEDVLKEAVNLIQSLDPRPGQSIQTGEPEYVIPDVLVRKHNGHWTVELNSDSIPRLQINQHYASMCNNARNDGDSQFIRSNLQDAKWLIKSLESRNDTLLRVSRCIVEQQQAFFEQGEEYMKPMVLADIAQAVEMHESTISRVTTQKYLHSPRGIFELKYFFSSHVNTEGGGEASSTAIRALVKKLIAAENPAKPLSDSKLTSLLSEQGIMVARRTVAKYRESLSIPPSNQRKQLVMKQGLQLRLSQQLAMTPQLQQAIRLLQLSTLELQQELQQALESNPLLEQIDTHEEIDTRETQDSETLDTADALEQKEMPEELPLDASWDTIYTAGTPSAPAVTYIDDELPVYQGETTQTLQDYLMWQVELTPFSDTDRAIATSIVDAVDETGYLTVPLEDILESIGDEEIDIDEVEAVLKRIQRFDPVGVAAKDLRDCLLIQLSQFDKTTPWLEEARLIISDHLDLLANHDFRTLMRVTRLKEDVLKEAVNLIQSLDPRPGQSIQTGEPEYVIPDVLVRKHNGHWTVELNSDSIPRLQINQHYASMCNNARNDGDSQFIRSNLQDAKWLIKSLESRNDTLLRVSRCIVEQQQAFFEQGEEYMKPMVLADIAQAVEMHESTISRVTTQKYLHSPRGIFELKYFFSSHVNTEGGGEASSTAIRALVKKLIAAENPAKPLSDSKLTSLLSEQGIMVARRTVAKYRESLSIPPSNQRKQLV

SEQ ID NO: 10001 - protein, 956 aa, Pantoea ananatis LMG 20103
MKQGLQLRLSQQLAMTPQLQQAIRLLQLSTLELQQELQLALESNPLLEQTDLHDEIDAKEYQEGEAGLDTREALEQKDMPEELPLDATWDEIYTAGTPSGTGTDYQDDELPIYQGETTQSLQDYLMWQVELTPFSDNDRAIATSIVDAIDDTGYLTVSLEEILDSIGNDELEIDEVEAVLKRVQRFDPVGVGARDLRDCLLVQLSQYAPETPMLAEAKLIVSSHLDLLANHDFRSLMRVTRLKEDVLKEAMLLIQSLDPRPGQSINTGEPEYVIPDVLVRKVTTRWTVELNTDSLPRLKINQQYAAMGGAGRNDSDSQFIRSNLQEARWLIKSLESRNETLLKVSRCIVEQQQAFFDQGEEFMRPMVLADIAQAVDMHESTISRVTTQKYLHSPRGIFELKYFFSSHVNTEGGGEASSTAIRALVKKLISAENPAKPLSDSKLTSMLSDQGIIVARRTVAKYRESLSIPPSNQRKQLVMKQGLQLRLSQQLAMTPQLQQAIRLLQLSTLELQQELQLALESNPLLEQTDLHDEIDAKEYQEGEAGLDTREALEQKDMPEELPLDATWDEIYTAGTPSGTGTDYQDDELPIYQGETTQSLQDYLMWQVELTPFSDNDRAIATSIVDAIDDTGYLTVSLEEILDSIGNDELEIDEVEAVLKRVQRFDPVGVGARDLRDCLLVQLSQYAPETPMLAEAKLIVSSHLDLLANHDFRSLMRVTRLKEDVLKEAMLLIQSLDPRPGQSINTGEPEYVIPDVLVRKVTTRWTVELNTDSLPRLKINQQYAAMGGAGRNDSDSQFIRSNLQEARWLIKSLESRNETLLKVSRCIVEQQQAFFDQGEEFMRPMVLADIAQAVDMHESTISRVTTQKYLHSPRGIFELKYFFSSHVNTEGGGEASSTAIRALVKKLISAENPAKPLSDSKLTSMLSDQGIIVARRTVAKYRESLSIPPSNQRKQLV

SEQ ID NO: 10002 - protein, 479 aa, Desulfobacterium autotrophicum HRM2
MALGLQQNLILTQQLVMTPQLQQAIKLLQLSRLELAGMIEQELEENPALEESIQEITQAEAREIEREADTKDQNEDLKEVTIEEKLSQDTDWESYINEYNSTGRVHSERDFQEAPNYEAFTSAKKTLEDHLQWQLLMNSPTPDQEQIGSMIIGSLNVDGYLCSTVEEIAEPGGFEIEAVEAMLKTLQTFDPPGVCARDLRESLLIQITRLGIEDPMLERIITRHMKNLENKNYKKIAKDLGISIDHVVSAVNVIKCLEPKPGREFSTEEPQYIIPDIYVYREGDDFKIVMNDDGLPKLRINRVYKEAVAKGTKISKETKTYLNEKMQSASWLIKSIHQRQKTIYSVMESIIKFQREFFLNGITQLKPMILRDVAEDIQMHESTISRVTTNKYAYTPQGLFELKYFFNSSISRTDGDSMASASVKDKIKLIIEKEDPQNPYSDKRLTEILEEANINIARRTVAKYREMLHILPSSKRKQF

SEQ ID NO: 10003 - protein, 520 aa, Rhizobium leguminosarum bv. phaseoli
MALSANLFLRQSQSLVMTPQLMQSIQLLQMTHFELNQFIAQEVEKNPLLEFPSNDGEAGDERGAGEDEPFGQPSEDAGSDDGADSRAEALSSDWYDNGGSESTGRLNDELDANYTNVFPDDGGPQRLDAPELVGQWKSMPGSAEGADYDLDDFVAGQLSLRDHLAQQIPFVLPDMTDRLIAQNFVDQLDDAGYLQTDLVETGERLGTSLEQVEHVLAALQTLDPPGVFARSLAECLAIQLRQKDRYDPAMQALVANLELLARRDFATLKRLCGVDEEDLLDMLGEIRQLNPKPGGGFEAGVSEAIMPDVVVRPSADGGWLVELNPDTLPRVLVNQSYFSRVTRNGEDHAFLSECLQSANWLTRTLDQRAKTIMKVASEIVRQQDAFLLNGVDHLRPLNLKTVAEAIKMHESTVSRVTSNKYMLTPRGLFELKYFFTVSISAVEGGEQHSAEAVRATRFRALIMQESPDAVLSDDDIVDMLKKGGIDLARRTVAKYREAMNIASSVQRRREKRALAKVAGF

SEQ ID NO: 10004 - protein, 497 aa, Pseudomonas aeruginosa
MKPSLVLKMGQQLTMTPQLQQAIRLLQLSTLDLQQEIQEALESNPMLERQEDGDDFDNSDPLADGAEQAASAPQESPLQESATPSVESLDDDQWSERIPSELPVDTAWEDIYQTSASSLPSNDDDEWDFTARTSSGESLHSHLLWQVNLAPMSDTDRMIAVTIIDSINNDGYLEESLEEILAAIDPELDVELDEVEVVLRRIQQLEPAGIGARNLRECLLLQLRQLPSTTPWLNEALRLVSDYLDLLGGRDYSQLMRRMKLKEDELRQVIELIQCLHPRPGSQIESSEAEYIVPDVIVRKDNERWLVELNQEAMPRLRVNATYAGMVRRADSSADNTFMRNQLQEARWFIKTLQSRNETLMKVATQIVEHQRGFLDYGEEAMKPLVLHDIAEAVGMHESTISRVTTQKYMHTPRGIFELKYFFSSHVSTAEGGECSSTAIRAIIKKLVAAENAKKPLSDSKIAGLLEAQGIQVARRTVAKYRESLGIAPSSERKRLV

SEQ ID NO: 10005 - protein, 489 aa, Pseudomonas putida BIRD-1
MGQQLTMTPQLQQAIRLLQLSTLDLQQEIQEALESNPMLERQEDGEDFDNSDPMADNAENKPAAEVQDNSFQESTVSADNLEDGEWSERIPNELPVDTAWEDIYQTSASSLPSNDDDEWDFTTRTSAGESLQTHLLWQLNLAPMSDTDRLIAVTLIDSINGQGYLEDTLEEICAGFDPELDIELDEVEAVLHRIQQFEPAGVGARNLGECLLLQLRQLPATTPWMTEAKRLVTDFIDLLGSRDYSQLMRRMKIKEDELRQVIELVQSLNPRPGSQIESSEPEYVVPDVIVRKDSDRWLVELNQEAIPRLRVNPQYAGFVRRADTSADNTFMRNQLQEARWFIKSLQSRNETLMKVATQIVEHQRGFLDHGDEAMKPLVLHDIAEAVGMHESTISRVTTQKYMHTPRGIYELKYFFSSHVSTSEGGECSSTAIRAIIKKLVAAENQKKPLSDSKIAGLLEAQGIQVARRTVAKYRESLGIAPSSERKRLM

SEQ ID NO: 10006 - protein, 477 aa, Shigella boydii Sb227
MKQGLQLRLSQQLAMTPQLQQAIRLLQLSTLELQQELQQALESNPLLEQIDTHEEIDTSETQDSETLDTADALEQKEMPEELPLDASWDTIYTAGTPSGTSGDYIDDELPVYQGETTQTLQDYLMWQVELTPFSDTDRAIATSIVDAVDDTGYLTVPLEDILESMGDEEIDIDEVEAVLKRIQRFDPVGVAAKDLRDCLLIQLSQFDKTTPWLEEARLIISDHLDLLANHDFRTLMRVTRLKEDVLKEAVNLIQSLDPRPGQSIQTGEPEYVIPDVLVRKHNGHWTVELNSDSIPRLQINQHYASMCNNARNDGDSQFIRSNLQDAKWLIKSLESRNDTLLRVSRCIVEQQQAFFEQGEEYMKPMVLADIAQAVEMHESTISRVTTQKYLHSPRGIFELKYFFSSHVNTEGGGEASSTAIRALVKKLIAAENPAKPLSDSKLTSLLSEQGIMVARRTVAKYRESLSIPPSNQRKQLV

SEQ ID NO: 10007 - protein, 497 aa, Pseudomonas putida KT2440
MKPSLVLKMGQQLTMTPQLQQAIRLLQLSTLDLQQEIQEALESNPMLERQEDGEDFDNSDPMADNAENKPAAEVQDNSFQESTVSADNLEDGEWSERIPNELPVDTAWEDIYQTSASSLPSNDDDEWDFTTRTSAGESLQSHLLWQLNLAPMSDTDRLIAVTLIDSINGQGYLEDTLEEICAGFDPELDIELDEVEAVLHRIQQFEPAGVGARNLGECLLLQLRQLPATTPWMTEAKRLVTDFIDLLGSRDYSQLMRRMKIKEDELRQVIELVQSLNPRPGSQIESSEPEYVVPDVIVRKDSDRWLVELNQEAIPRLRVNPQYAGFVRRADTSADNTFMRNQLQEARWFIKSLQSRNETLMKVATQIVEHQRGFLDHGDEAMKPLVLHDIAEAVGMHESTISRVTTQKYMHTPRGIYELKYFFSSHVSTSEGGECSSTAIRAIIKKLVAAENQKKPLSDSKIAGLLEAQGIQVARRTVAKYRESLGIAPSSERKRLM

SEQ ID NO: 10008 - protein, 476 aa, Laribacter hongkongensis HLHK9
MKQSLQLKLSQQLTLTPQLQQSIKLLQLSTLDLQQEVEQFLADNPLLERVEDGEHDDGATAADEPAELAPAEHAGSDDPREHDDSARDLDTLNDWSSSGIRGSDEDDDWDPHANLIRPQSLREHLLAQLAEVPLSARDRAVATFLVEEIDDDGYLPASLESLAEQLPASLEVELDELTIALRLIQQFEPAGVGARDLTESLLLQLRARSGTDECTLAHTIVRDHLQLLANRDFTRLRRATSADDEALRQAQALIASLNPRPAAGFASGDTHYVMADVIVRRDRQGIWQAHLNPASQPRLKVNQMYANLLGRCRGEGGELSGRLQEAKWLIRNIEQRADTILRVSSVIVERQQGFFEQGELLMKPMVLRDVAEELGLHESTISRVTSNKYLLCPRGIFELKYFFGSALDTDSGEECSATAIKARIRRLIAEEDARKPLSDNTIADLLGEEGIQVARRTVAKYREALLIPPASQRKMI

SEQ ID NO: 10009 - protein, 451 aa, Kingella kingae
MTSTKFQLKLKQTLQLNQAMQQSLRVLQMSGLEVEREVEDWLADNPLLERRESEDWGKEPHYTANISSKRHISLDDDDSSAWENLVEEETLNAYLHKQVSEHPLSPEEAARVHVLIDFLDDKGYLTESIEEIIDHTPLEWMLDEDNMELALEQLREFDPPGIATTNLQQSLLHQLDRLPLSAERRCAAHIVVHYLDNISQNTPRNINKLSKLMPDTPKSTIEDALEMISSLRPYPAYGFAIDEPTAYVRPDVFIESHRGEWVVVCNDDAIPQIQINPELSEALQEIENDAVWREKMVHAKQKIDMLQQRKSTIMRVAEYIVERQQDFFTFGEIGLVPMLIKDCASALELAESTISRAVNSKYLACPQGLFALRYFFSQNAIGSNQGEDGISGNAIRSLIAQIVDNEDKTKPLSDTDLHQLLQQQGITIARRTVAKYREQLGIPTVQQRRQV

SEQ ID NO: 10010 - protein, 500 aa, Ralstonia solanacearum UW551
MVKAALEMRAKQHLALTPRLQQSVKLLQLSATEFAQEMQEALASNPFLEEVDDSTGTPPEAARAGDAMPGIEADGAPPDRTPPEDVPLETTTSAIETDPAIAASEEFPTDFGSYTSYGPAHHGDGEDSDIGEWVHATPTLREHLHQELGSYRLSERDSLLAQTLIEALDDDGYLRQMLSELMPLAPVEPAPTEKEMQIALALVQSLDPPGVAARDLAECLRLQIEALPADTETEERVQEIALDIVRSHLQRLAKRDLTYIRRAVGCEEDELREACALIRTLDPRPGLRFSQAHAGYIVPDVIVAKIKGKWVALTNPSVAPCARINKIYAELFAQTRGHHRTPLAHQLQEARWLIRNAQQRFATIQRVAEAIVAHQKHFLEYGEVAMRPLVLRDVAEELGLHESTISRATGNKFMATPRGIFEFKYFFSRQLATDTGGACSAASVRALLKEMIEAEDAQAPLSDVSLAKMLAEQGVIVARRTVAKYRGLMRIAPAELRRQV

SEQ ID NO: 10011 - protein, 436 aa, Chlamydia trachomatis A/HAR-13
MLHQHQTASVALCPALHLQQGLDMLQMPVAELATFVSQQITINPCFDLDSLDSPPESFSFFPISEQHPFTETLSAYLLRQIDTNFASSQERTIAQYIVGNLSPEGLFLENPSLVAADLNVSEHLFHKVWQRIQQLHPLGVGAPSLQSYWVSLLQTSPHKEALAIIRNHFPRLARCDFTTIARKMHATTTEILTFLRHAFASIPWCPAAGFSETLLPPAPALPDAYLSFSRNSSWDVSINKDCLPSIRLNNTVLDIYPSLPREEKDHLSQQIRAAKQLLRNVKKREETLLAILRVLIPYQEEFLLKKRTSPKAFSVKQIARELSLHEATVCRAIDNKTLATPVGLLPMRSLFPQAVGSCPDQSKATILHWIHQWISTEKHPLSDAAISQKIIEKGIPCARRTVAKYRSQLNILPAHQRKHLCSVLTTTRTENSRHTI

SEQ ID NO: 10012 - protein, 479 aa, Aeromonas hydrophila subsp. hydrophila ATCC 7966
MKPTLQLRLGQSLTMTPQLQQAIRLLQLSTLELQQEIQQALDNNPLLEQEENDVQETSPEEPVDASQLDSSDAMSQDNMPDELPVDTTWEEVYSAGTAQSAGPIHDGEDSIYQGETTENLQDYLLWQMRLTPFSDVDAAIALAIIDAIDESGYLTVSLEDIQTAVSSEDVEVELDEVEAVLKRVQHFDPVGIAARSVQECLLIQLGQYSPDLPWLNEAKEVILEHMDLLGNRDYRTLARKTRLKESDLKEVLDLIQQLEPRPGNGVIQSESQYVIPDVSVVKKGNKWVVELNPDSAPRIRVNETYAAMARQARTSQDTQFIRSHLQEAKWFIKSLESRNDTLLKVASCIVEQQQGFFEYGEEAMKPMVLNDIAEAVEMHESTISRVTTQKYMHTPRGIFELKFFFSSHVNTEGGGECSSTAIRALIKKLVTAENPAKPLSDSKIADLLAEQGIMVARRTIAKYRESLLIPPSNQRKRLV

SEQ ID NO: 10013 - protein, 477 aa, Escherichia coli str. K-12 substr. MG1655
MKQGLQLRLSQQLAMTPQLQQAIRLLQLSTLELQQELQQALESNPLLEQIDTHEEIDTRETQDSETLDTADALEQKEMPEELPLDASWDTIYTAGTPSGTSGDYIDDELPVYQGETTQTLQDYLMWQVELTPFSDTDRAIATSIVDAVDETGYLTVPLEDILESIGDEEIDIDEVEAVLKRIQRFDPVGVAAKDLRDCLLIQLSQFDKTTPWLEEARLIISDHLDLLANHDFRTLMRVTRLKEDVLKEAVNLIQSLDPRPGQSIQTGEPEYVIPDVLVRKHNGHWTVELNSDSIPRLQINQHYASMCNNARNDGDSQFIRSNLQDAKWLIKSLESRNDTLLRVSRCIVEQQQAFFEQGEEYMKPMVLADIAQAVEMHESTISRVTTQKYLHSPRGIFELKYFFSSHVNTEGGGEASSTAIRALVKKLIAAENPAKPLSDSKLTSLLSEQGIMVARRTVAKYRESLSIPPSNQRKQLV

SEQ ID NO: 10014 - protein, 368 aa, Thiocapsa roseopersicina
MKQSIQLRLGQHLTMTPQLQQAIRLLQLSTLELQKEIQEALDTNLMLEEGDEADRFNVGEQPQTGTIQSEDIETPRLAVEQTVDREIHAESNEMPDELPVDTLWTDVFDSYLPSTSHGSDDGSDYDPFAQQSRPQTLLDHLAWQLNLCRLSERDNMIAQAVIDSIDADGYLRIDIDELLLTVDHPEISAEEVEAVVHRIQSFDPPGVGARNLPECLLIQLSQLPAQTPWRNAAMAICRDGFEYLAKRDVASLVRQLKESEEAVAGALALIRRLNPRPGSLIAGAPAQYVVPDIFVRKREGRWSVELNPESMPKLRVNAEYARLIRRADQSADGVTLKSHLQEARWFIKSLASRNDTVLRVGAKIVEMQ

SEQ ID NO: 10015 - protein, 482 aa, Acinetobacter baumannii 1656-2
MKLSVGLKVANSLSLTPQLQQAIRLLQLSSLELEQEIQIQLDSNPLLEKVEDESLAESLSTLEHKETDDLTTELNADHLPDDLPVDTEWDDIYTHQSTALGTPEFEEREDNRQVHLTLKEHILEQVNLLHFSKIDQLIAYCIVDALDDKGFLDAELEEIILAVQHLLSEMDIDEEVEEDEVLVVLKHIQRLDPIGIGARNLAECLKVQLEFLPRETEYLKEARSLLQYYELLIANDLNKLLKQTGLSKEQLKFAVDLLKTLKPYPGMDFEKQESEYQIPDVVVAKKDLHWQVQLNPDVMPKLRINSFYSSMIRRADQSDDNLYLRNQMLEAKNFIKSIDERHKTILKVATCIVEHQKAFLEIGPEAMKPLVLRDVAEEVELHESTVSRVTTNKYMLTPRGLFELKYFFSSHVGTTTGGEASSTAIRAMIKKLVSNENPRKPLSDNAIAALLKEEGIEVARRTVAKYRESLHIPSSSARKVLI

SEQ ID NO: 10016 - protein, 484 aa, Mesorhizobium loti MAFF303099
MESSASLLQRQKQSLVLTPQMMESIRLLQLAHPELHQFVEQEIEKNPFLERASNRAPKDIPSISAGNPRIGPTTGGISDRASQWKSIRGKNNVQPGGNHAFEDSWTSIETLHDHVARQIALSAFAPLERRIAGELAGHLEDTGYLPVNLSELARSLNVREAVVERVLGTLQQFDPPGIFARTLSECLEIQLRQLDRFDPAMAALVANLEALARRDFQTLKRHCGVDEDDLLDMLHEIRALDPKPGNRFQSGGPESIIPDVLVQPSPGGGWQIELNPDTLPRLLMNQNYFAQVSRLSAQNSKDQSFLNECLQNANWLIRSLDQRAKTILKVAAEIIRQQDAFFEHGVAHLRPLNLRTVADAINVHQSTVSRVTSNKYMLTPRGVFELKYFFTVAIGSSEGGDAYSAEAVRHQIKAMVAVESPNEVLSDDDIATRLKETGIDIARRTVAKYREALNIPSSARRRREKRVRLRCQSSPVGGGDESGS

SEQ ID NO: 10017 - protein, 477 aa, Yersinia pestis KIM
MKQGLQLKFSQQLAMTPQLQQAIRLLQLSTLELQQEIQLALESNPLLEQTDLHEEIDAKETVDSESLDTREALEQKDMPEELPLDATWDEIYTAGTPSGMGNDYSDDELPVYQGETTQTLQDYLMWQVDLTPFTETDAAIATSIVDAVDDTGYLTVPLEDILESMGDENVALDEVEAVLKRIQHFDPIGVAARNLRECLLVQLSQYAKDTPYLAEARLIVSEYLDLLGNHDFRMMIRLSRLKEDTLKEAIALIQSLDPRPGQSINTGESEYVIPDVLVRKEKGIWTVELNADSIPRLKVNQQYAAMGNSVRNDSDGQFIRSNLQEAKWLIKSLESRNETLLKVARCIVEQQVEFFEKGAEFMKPMVLADIAQAVDMHESTISRVTTQKFLHSPRGIFELKYFFSSHVNTDSGGEASSTAIRALVKKLVAAENPAKPLSDSKLTTLLCEQGIMVARRTVAKYRESLSIPPSNQRKQLV

SEQ ID NO: 10018 - protein, 497 aa, Pseudomonas syringae pv. Glycinea
MKPSLVLRMGQQLTMTPQLQQAIRLLQLSTLDLQQEIQEALESNPMLERQEEGDDFDNSDPLADNIEQKPNPDVQEPTYQESAPTVDNLEDGEWNERIPNELPVDTAWEDIYQTSASSLPSNDDDEWDFTTRTSAGESLQSHLLLAIELRPISDKDRLVAVTLIDCINNQGCLDETLDEILESFDPELDIELDEIEAVLHRIQQFEPAGIGARNLSECLLLQLRQLPAKTPWLMEAQRLVTDYIDLLGSRDYGQLMRRMKLKEDELRQVIELVQSLNPRPGSQIESTEAEYVIPDVIVRKDNERWLFELNQGVRTRLRVNPQYAGFVRRADTSADNTFMRNQLQEARWFTKSLQSRNETLMKVATQIVEHQRGFFEYGDEAMKPLVLHDIAEAVGMHESTISRVTTQKFMHTPRGIYELKYFFSSHVSTSEGGECSSTAIRAIIKKLVAAENQKKPLSDSKIAGLLEAQGIQVARRTVAKYRESLGIAPSSERKRLM

SEQ ID NO: 10019 - protein, 504 aa, Prevotella multiformis DSM 16608
MAQEQVQLQTQKQQQVQRLSQQQMLQVKLLEMPLTELEESVNAELDDNPALESGGEETDDMDTDGSAEQTEGDDFDTQQEREERQDALDSALERMRSDDELPAYDSRQQRNNADYEEIVYGDTVSFIDKLNEQVGERELTDRQRDILEYLIGSLDNDGLLRKDLGSISDELAIYHGIDATAGELEEALKILQDFDPAGIGARTLQECLLLQVDRKVENGEWAGDGKLYRCVRTILADYFDAFTKKHWDKIQTALSLSDHQVETLQREIRRLNPKPGASMGETQGRNLQQITPDFIIDTEDDGTITFSLNHGNLPELHVSPAFNEMLAAYRDNKAGMNRQEKEALLYAKEKVDKAQGFIEAVKLRRHTLQVTMKAIIDIQRRFFQDGDEADLKPMILKDIADRTGLDISTISRVSNIKYAQTRWGIFPLRFFFSDSYTTEDGEEMSTRKIKVALKEVIGQEDKRRPLSDDALAKVMKEKGFPIARRTVAKYREQLGLPVARLRKE

SEQ ID NO: 10020 - protein, 434 aa, Rhodobacter sphaeroides 2.4.1
MDMMQFQRQTTQLAMTQRMQESLRILQMSNADLADYLTAQALENPCLEVRVPEGASVAPALPSRGIQAGLDRDAFATVEGQPPSLLAHVEAQIDLAFFDPGDRRTALAFAEALEPSGWLGQPVSEVAAAAEVEEEEALVILERLQALEPAGLFARSLAECLALQLEDLGLLTWELRTMLDHLPLLAEGRIADLARRCDCEPEHIRENLALIRSLSPKPGEAFAADRTPIQPPDVRVLRGPEGWEVELTRAQLPRIRVSEAGDTGDRQADAWLARARSQARWLERAVERRQATLLRTAVCLVRHQADFLDQGPRALRPLSMEEVALELDLHPSTISRATATRLIETPRGLIPLRAFFSRSVSSDGPEAPQSQDALMALVREIIAREDRTKPFSDDAIVKQAKLAGAVLARRTVTKYRETLGIPSSYDRKRAAAAA

SEQ ID NO: 10021 - protein, 499 aa, Prevotella oralis ATCC 33269
MDQKLVQTQVQKQLQVQRLSQQQMLQVRLLEMPLTELEESVNAELDDNPALEASSSEDAMADSGFESIEEEREEMSEEEQNEHDDREEALENALENIGRDDRMPESYGYTDNDNNADYEEVVYGDTVSFYDKLKEQMGETVLTDRQQDIMEYIIGSLDDDGLLRKDLESISDELAVYHNIDADTEEIEQVLRLLQAFDPAGIGARSLQECLRLQVERRAESPVKAAMLRLIDGYFDEFTKKHWHKIQIGMHLTDAWLHLLQDEIRKLNPKPGASLGETEGRNIQQITPDFIVDTSDDGVISFSLNRGNIPELKVSPSFSEMVDTYRNNKEGMTRQAKEALLYAKEKVEKAQGFIEAVKQRRHTLYITMKAIIEWQRKFFLDGDEADLKPMILKDIADKTGLDISTISRVSNVKYAQTKWGTFPLRFFFTDSYTTDSGEELSTRKIKLVLKEIIGKENKTKPYSDDALSLLMKAKGFPVARRTIAKYREQLGIPVARLRR

SEQ ID NO: 10022 - protein, 398 aa, Aquifex aeolicus VF5
MLNQRLEVRQKLNLKLLLKQDLELLTYQTQELEKLIHEEVLVNPLIKGVFKKIPKSFEVKETVPYQIPYTPSELEELQQNIKLELEGKEQELALELLNYLNEKGFLSKSVEEISDVLRCSVEELEKVRQKVLRLEPLGVCSKDVWEFLELQIEEIYPEEEEILKKALRDLKRGKKLKPEIKGKLSRLRLFPLSSSAEKVYTFAKVDAIIEEENGEFFIYLYEDFIDIDLNEEYWELYKKSRNLQKELKEAFERYESIRKVLDIRRRNLRKVLEKIVERQKDFLTGKGSLKPLTLREVSSEIGIHESTLSRIVNSKYVKTPVGTYSLRTFFVRESAEGLTQGELMKLIKEIVENEDKRKPYSDQEIANILKEKGFKVARRTVAKYREMLGIPSSRERRI

SEQ ID NO: 10023 - protein, 569 aa, Psychrobacter arcticus 273-4
MSMSFGLATTLSISQKLTPQMQQAIKLLQLSSLELAQEVQAKLDSNPLLERIEDDEDEYESADKSADKDALVEFGEPLTLDSWNQNTASDTFSVSSSSNNEDEFEYDDSISDSLDKLQQDSFDTDAIDSYMLEDFDGSNEESLNYDSPYAEYDGFDTASAGTGSPSARPDSDDFDSYQGSTNATIQDHVRWQLNFKRLSETDTLIAEYLMDSMDDMGFVRLDIEELLQSFDTIASFYQWDERVEHDEVMAVLRMIQSCDPLGVGARNLSECLAIQLSKLDTDIPYLKQAQALLSASEHLVSNNIKALTERTGLAAQEITPALMLLRSLNPSPGLLFQSRQPDYTQSPDSYDIPDVLVTPIRRHDANQNTDTSTQEDGWQVRLNPETLPKLRVNQEYANLVKRGDNSPDNQYLRENLTDARLFIRSIEERNQNLLKVATSIVRYQQAFLQYGATAMQPLILKVIADEVDLHESTVSRLTTSKTILTPQGLFSLKHFFSSHVSSSDGDISSIAISAMIKQLIADEEPKKPLSDSKIKNYLLAEGIDIARRTVAKYREAMSIGSSTQRKQKY

SEQ ID NO: 10024 - protein, 503 aa, Prevotella buccae ATCC 33574
MAQKLVQTQVQKQQLLQRLSAQQMLQVKLLEMPLTELEQNINAELDDNPALESASADDALDLEGADGGDTTGDSSEQEDGETSEYEREEREDALDAAFDNIGRDDEMPEVGGNRNYQNADYEETVYGDTTSFYDTLKEQMDMQHLTEKQHDMMEYIIGSLDDDGLLRKDLDSISDELAVYHNIDASADELEEVLHRLQEFDPAGVGARNLQECLLLQIARRPDDKLRRAMEEVITNYFDAFTKKHWDKIQAGLQLSDTQTETLQNELRRLNPKPGASLGETIGRNLQQITPDFIVDTNEDGSVSFSLNRGNMPELHVSPSFTEMLENYKNDKHPAGRQTKEALVYAREKVEKAQSYIEAIRQRRLTLYATMKAIIEIQHKFFADGDEADLKPMILKDVADRTGLDISTISRVSNVKYAQTKWGTYPLRFFFSDGYTTEDGEEMSTRKIKLALKDLIGKENKKKPMSDDTLAEEMKKLGYPIARRTVAKYREQQGIPVARLRKE

SEQ ID NO: 10025 - protein, 504 aa, Prevotella marshii DSM 16973
MAQKLTQEQTQKQVQVQRLSQQQMLQIKLLEMPLTQLEQSVMAELDDNPALEAGSPDDMAESEPEESAGLSDSDREGNEDYDAMTEREEREAALDDALSNIGIDDRMPEYETGMHDRQTADYEEIVYGDTTSFYDKLKEQMGETELTERQREIMEYLIGSLDDDGLLRKETETISDELAIYHAIDATPKEIEAVLHILQTFDPAGIGARSLQECLLLQIARREPSPLTEQMRRVITDNFEAFTKKHWDTIGRQFGLTDKQVTMLQEELRRLNPKPGAALGETQGRSVQQITPDFLIETHEDGTVSFSLNKGHLPELYVSPSFREMLKTYHTDRKTMSRQDKEALLYAKEKVERAKGFIEAVKQRRHTLVVTMQAIIDRQKQFFIDGDEADLRPMVLKDIADKTGLDISTISRVSNIKYAQTKWGTFPLRFFFTDGYTTEAGEELSTRKMKIALKEIIDGEDKHRPMSDDQLKEEMKRKGFPIARRTVSKYREQLGVPVARLRRE

SEQ ID NO: 10026 - protein, 497 aa, Pseudomonas fluorescens
MKPSLVLRMGQQLTMTPQLQQAIRLLQLSTLDLQQEIQEALESNPMLERQEEGDDFDNSDPLADNTESKPNTEIQEPSYQETAPTVDSLEDGEWNERIPNELPVDTAWEDVYQTSASSLPSSDDDEWDFTTRTSAGESLQSHLLWQLNLAPMSDTDRLIAVTLIDCINNQGYLDETLEEILEAFDPELDIELDEIEAVLHRIQQFEPAGIGARNLGECLLLQLRQLPAKTPWLGEAQRLVSDYIDLLGSRDYSQLMRRMKLKEDELRQVIELVQSLNPRPGSQIESSEAEYVVPDVIVRKDNERWLVELNQESVPRLRVNAQYAGFVRRADTSADNTFMRNQLQEARWFIKSLQSRNETLMKVATQIVEHQRGFLEYGDEAMKPLVLHDIAEAVGMHESTISRVTTQKFMHTPRGIYELKYFFSSHVSTSEGGECSSTAIRAIIKKLVAAENQKKPLSDSKIAGLLEAQGIQVARRTVAKYRESLGIAPSSERKRLM

SEQ ID NO: 10027 - protein, 490 aa, Acidiphilium multivorum AIU301
MAIGPRLDLRHTQSLVMTPQLRQAIQLLQFTNAEVSQFIEDELLKNPLLERVEPEADAALPVPRNDAASTEKPTGDIGAEHVVDPDPSGASTPLDVDFSNVYDAGGVGDGTSSGLSPERDDWIGQIADRPPGLRESLDQQARLAFADPVRRRIAFALIMALDPAGRLADPPEQIAERLAVAPDMLEAVRQTMMRFDPTGMFARDLAECLAVQLDERNRLDPAMRALLANLELLARRDLRSLMEICGVDAEDLRDMIAEIRRLNPKPGATFDVTPMTPLIPDVLMRPGPDGDYFLELNPETMPRVLIRRGFHAQIVARASRETRQFLSERVQSANWLVRALESRAETILRVAGEIVRHQDAFFRHGIGFLRPLTLREIAAALEIHESTVSRVTSNKVIATPRGIFEMKFFFTTALAGANGESHSAEAVRHRISTLIEGEAANRILSDDALARMLQKEGIDIARRTVAKYREALRIPGSAQRKREKGLLAGG

SEQ ID NO: 10028 - protein, 439 aa, Enterococcus casseliflavus ATCC 12755
MMKFQQQFSQQQKQTQKLAMTQKLQQSIQVLQFSADELLSFIDNQALENPLIDLGEYDSPITLSKSSGSSEQIMDYLSQIPDQHTSLFEHLIDQVHLNYRDTFLRTIVLFLVEYIDLNGFLTIDLEEAGKLVGGTPIQMLDALTLIQQLDPAGVGARDLRECLMLQTERDDYAPPMAYLILEEFFTEMAERKWDKISKALQIPLTEIQKVFDYVQTLTPTPGAAFGSTDGLYIVPDLRVTVEKGQPIVKSNKRALPEVRFQQQYFDQLKQSGDPEVLSYLDNKAQEFEWLKKTLLQRGDTIYRVGVQIVARQKEFFTQPDRPLKPLVLREVAEELGIHESTVSRAVNGKYLETSFGVFELKLFFGQKVSTQESGDDLTTASIKQQLKALIDEENKNKPLSDQKLTDALKAQGIDISRRTVAKYREAMNIPGSSKRKRFE

SEQ ID NO: 10029 - protein, 453 aa, Kingella denitrificans ATCC 33394
MNGTNFQLKLKQTQLLNQAMQQSLRILQMSGLEVEREVEDWLADNPLLERTESDEPPYEMPQYTADIAHRHLSLDDDNVSAWENLAEEETLNAYLHKQVSEHPLSPIEAARVHILIDFLDEKGYLTESIEEIIENTPLEWMLEEEDMELALEQLQKFDPPGIATQNLSQSLLHQLDQLPPSQERRCAAHIVMHHLEHISQNTPKNINKLSKLLPDYSEDTIKSALEMISSLHPYPAYGFAGNEPTAYVRPDVFVQKNSQGGWTVVSNQDSMPQIHINTELAEALQDCEELDPVWREKITSAKQKLDMLQQRKNTIHRVAEYIVERQQDFFTFGEIALAPMLIKDCANELDLAESTISRAVNSKYLACPQGLFALRFFFNQNAVGNNQSEDGISAHAIRSLISQIVANEDKHKPLSDNDLQQLLKQQGINIARRTVAKYREQLGIPTVQQRRHT

SEQ ID NO: 10030 - protein, 416 aa, Campylobacter jejuni RM1221
MLKQKITQAPKTKISQTLRSWLPILQANIEDLKENLDKFAEDNPFLNVQDSIQTHDKGKNYFDSFYKHNVNSAFVDSKGLAKKSVYELLNEQILPPLFPTNKSQELAKKIIECLNEEGYFEYDEEFLKEYSLEEIERVRARFKFLDPVGVGAKDYKEAFLFALENMELDEDIDEFCRMLIMDFENIQNYTKEPLYKEALAVLKRFSTPPFLEYFEDSRIIVPDIFVYKENGEIKVKINDDYYPEISIQTDGLEHDFLSHYIKEAKNLVDALAMRKATLYKIGLMIVEYQYDFFMGKEIKPMTFKDLALDLERNASTISRAVANKYLSCERGLIPLRDFFAFALDEEGETSNVGVKEFVANLVKNEDRNKPLSDSKILELIKEEFKVDIGRRTITKYRKHLNIASSTDRKKLYELEG

SEQ ID NO: 10031 - protein, 488 aa, Capnocytophaga ochracea F0287
MLKQNLQLKLSQKLSPQQIQLMKLVQLPTLAFEQRVKQEMEENPALESGREEDALDEFHDEFDNTADEYNDNDVIDMDDINIDEYLSDDEIPDYRLHTNNYSDDDEDRDIPFSAEVSFHQSLINQLNTFTLSDEDYLIAEFLVGSIDDIGYIRRSIQDLTDDLAFTQNIYTEEEHVEQIRQQIIFQLDPAGVGASDLQECLLIQLRRKKQTPAIGLAIEVLTEAFEAFTKKHYTKLQQRFLVTEEQLKEAVQEVERLNPKPGSSYVGNNVHIEQIIPDFTVKVVDNELELSLNGRNAPELHVSKEYSTMLDTYKKSKEKSNSQKEAVFFIKQKLDSAKWFIDAIRQRQQTLLITMNAIMEHQREYFLTGDELKIKPLILKDIADKVGMDISTVSRVASSKYVITPYGTKLIKDFFSESMKNDQGEDVSTREIKQILQYIVAKEDKSKPLPDDELAQLLKKKGYPIARRTIAKYREQMDIPVARLRKEL

SEQ ID NO: 10032 - protein, 453 aa, Pseudoramibacter alactolyticus ATCC 23263
MSPMHLDLTLKAGQQLAMTPQMQTAIRLLQMNSLEIKDYLSQTMLENPMLVFQGETDTSEPDDAINWPDYFDQMDAAPTVREETRPSEERYRPEAWRKPVATLEEYLLLQLHTKGDIDTAIGEYIIGCIDADGYLSMDSDAARQLGVSPAAVAAALAAIQTFDPAGVGARNIGECLSIQLKQLGLWTPEGQMLLDEHLLDVANNQFKKVAAATGIPADEITRFKMLLTELNPRPGAVFDTEEPVDYIIPDGSIQWVDGELIIHINEISAPRLTLSRFYRRMLDHPDTPETKAYLEDCLNKARFIIQCIDMRRETIRKILTGIATYQADYFFSRCRCPKPMTQSQIAEMAGVHASTVSRAIRGKYVRTPRGTASLKSFFKRGYESDLGQLSVDGVKAQLSAWIQAEDPAHPLSDQDLTDRLNEHGCAIARRTVAKYRESLGLPVAARRRRPSKH

SEQ ID NO: 10033 - protein, 488 aa, Flavobacterium psychrophilum JIP02/86
MLKQFLNFKLSQKLSPQQIQLMKLIQLPTQAFEARLLEEMNENPALEGGDDQEEIYEKDEFDNNDDYDEYEDNDSIDSGDINIDEYLSNDETPDYKTQANNYSDDDDERESPLSAPVSFHQDLINQLNTFILTDDQRNIAEFLVGSIDDMGYIRRTIQDIVDDMAFTQGIYTDEKTVEKILHIVHELEPSGVGARDLQECLLLQLKHKTPTESVALAMNIIQDQFEAFTKKHYDKLMLKFSVSREQLKNGIDEIERLNPKPGGAYTGSNKITEHVVPDFAIKIIDDELELTLNGRNAPELHVSKDYQDMMKTYKDSKDKSNAQKDAVQFIKQKLDSAKWFIDAIKQRQETLYVTMNAIMHFQQEYFLDGDEANLKPMILKDIADMIGLDISTVSRVANSKYVDTPYGTKLIKEFFSEAMTNDQGEEVSTIEIKNILQTVIAEEDKNKPLPDDQLAEILKEKGYPIARRTIAKYREQLDIPVARMRKKM

SEQ ID NO: 10034 - protein, 418 aa, Campylobacter upsaliensis JV21
MLRQKLSQSPKTKLSNTLRSWLPLLQANIEDLKESLDKFAEDNPFLSIEEKAQTQKNGQNYYDNFFKRNAKSDILEQKALKEQSVWELLDEQIIPPLFPTAKSQTIANQIIQCLNHEGYFEYDETILREFTKEEVEKIRTRFKYLEPVGVGAIDFKEAFLFALENIEIKNDELYEFSKMLILDFENIQQYTKEKLYKEAIEMIKKFSIPPFLEYFEESRVIVPDIFIFRENGEIKVKINDDYYPEIHIETDGLEHEFLSSYLKEARNLVDALAMRKATLYKIGLMIVEHQYEFFLGKEIKPMTLKDLAQDLERNASTISRAIANKYLSCDRGLIPLKDFFAFALDGDGETSNASVKDFVANLVKNENKQKPLSDSKILELILAEFKIDIGRRTITKYRKQLGIASSTDRKKFYELEGS

SEQ ID NO: 10035 - protein, 407 aa, Fusobacterium nucleatum subsp. polymorphum ATCC 10953
MDNKLDIIEKQKLIQSLKLSQIMKLSINILKMSITELNNFIEKEISKDLSVSVELNYSNQENYDDEKEAEINYLTDEKNFFQILEEQLSYFKIETKIKEICVFIINNLNKKGYLELSKIEIKDILEVSDKELDEAFDVIHSLEPYGVGAYSLEECLKIQLKVKNLIDDKLFLFIDNYLYLLADKKYDLIKEKLNINDEQLFIYIDIIKSLNPIPSRGYSVGKVKKIIPDIFVETKKDEVFYEINRASIPQINVKDKINDKYYKKLNEIVSCIEKRFETLDKIMEIIIREQKSFFISQDKEINTLKISDVASELNLSPSTVSRAVKEKYIKTNFGIISLRKLFNLDSTVFLYQQKILEYIENENKEQPFSDQDIVNLLEKEGIKIARRTVTKYREKLGYKSSHKRKKY

SEQ ID NO: 10036 - protein, 461 aa, Clostridium tetani E88
MKNVDLGFELSISQEQKLIMTHQMQLSIKILQLSSYELTKLVEKQLQENPLLEINYEEIKKEESLEENLDEVLKYKNIIKNLQDDNYINNQHSEEEVSPFNFISSKKSLKEYLLEQIMYLDEKEYIKCICNYIIEGIDERGYLAEDIESISKELKVSINLVIKALNIVQDLEPDGIGARDLIECLRIQCNKREIKDEKIYNIIDNHLEDIAENKYSNIGKKLDISPKKAQMYGDFIKSLQPKPSSGFYTGEEVRYIVPDAYIKKIGREYVILMNESITPKLTINNLYKNIINNNEDEAAVEYVKEKLNSASYLIKSIEQRKSTIYRVLEKIIEIQREYFDKDKKHLKPMTLKEIAEELKVHESTVSRAIREKYIHTDKGIIKIRNLFTTAIESKGNEDSLSNIAVKNMIEKFIEEEDKKKPLSDQNIADRLKKKDVNISRRTVAKYREEMGIKSSMGRKRY

SEQ ID NO: 10037 - protein, 416 aa, Campylobacter coli RM2228
MLRQKTTQAPKTKISQTLRSWLPILQANIEDLKENLDKFAEENPFLSVQEPIQTHEHNKNYFDSFYKRNANSAFVDNKGLATKSVYELLNEQIIPPLFPTSKSQELAGKIVECLNHEGYFEYDEEILKDYDINELERIRARFKFLDPVGVGAKDYKEAFLFALENIELDAELYDFCKMLIQDFENIQNYTKEPLYKEALAIFKRFSIPPFLEYFEDSRVIIPDIFVYRENDEIKVKINDDYYPEISIETDGLTHEYLNHYIKEAKNLVDALMMRKATLYKIGLMIVEYQYDFFMGKDIKPMTFKDLALDLERNASTISRAVANKYLSCDRGLIPLRDFFAFALDEEGETSNVGVKDFVANLVKNENRSKPLSDSKILELIKKEFKVDIGRRTITKYRKHLNIPSSTDRKKLYELEG

SEQ ID NO: 10038 - protein, 484 aa, Methylovorus sp. MP688
MKQSLQLKFSQHLALTPQLQQSIRLLQLSTQELNQELETLLQANPLLERADKIEEPLEIPDNFIAAPVAPEPSVAATPEEAPRQDEFGGDDYFEFGSSSGSNRWEDSSSGNDDDNDFSYQEAVSLSLRDHLLGQLKLLPLSERDQTLSMLLVDTITDDGYLEQSLEELAEMLPPELEIDMLELQTALKHIQNLDPPGIGARNLAECLSLQLRALPPDTPYVDLAIKVAETHLPLLAARDYAKLKKLLACDDDVLREVQQLVLQLNPRPGGEFSKITSDHYIQHEIVVKKIKGVWLAHLNDEVVPKLRINQLYAGILKRNRESSSQYLMSQMQEAKWMIKNIQQRFSTILRVSQAIVDRQRNFFEHGEVAMRPLVLREIADELGLHESTVSRVTTRKYMLTPRGVYELKYFFGSHVATESGGACSATAIRALIKQMVSEENPKKPLSDNQITDILGKQGIVVARRTIAKYRESLQIPAANQRRSL

SEQ ID NO: 10039 - protein, 487 aa, Chryseobacterium gleum ATCC 35910
MLKQHLQLKLGQKLAPQQIQLMKLIQLHTLEFEEELERELEENPALEIAKEDSKEDDYSSLEDAYQDEGTESIETDFDVNEYIYDDEPSYKTASSNYSPDDEEFDNESLLTEGQSLYDYLTEQIHLVNISDEDLKIAEYLIGNLDTDGYLRREIKSIVDDLAFSQGIYTTKERVEDILENYVQKLDPPGVGARGLQECLLLQIEKKVSSDKAVSLAANILRHQFEALTNKHYNKIIQKYDIEEDDLKDALDEISKLSPKVGGNFDTQTITINQEIIPDFVIQVKDGQVIPMLNSKNAPTLRVSEEYKDILTTYSHDKNSSEHKQAALFIKQKLDAAKWYIDAINQRQNTLLQTITAIVKFQKDYFITGDEKSLKPMILKDVADITGFDISTISRVVKSKYADTPNGIVYLKDLFSDSLTNDDGEEVSTKEIKTHLQEVIDKENKRKPLTDDALVVILKEQGYNIARRTIAKYREQLNIPVARLRKEL

SEQ ID NO: 10040 - protein, 487 aa, Sphingobacterium spiritivorum ATCC 33861
MLKQTLQQKLLQKLSPQQIQFIKLLQVPTVSLDARIKEELEENPALEDGSLINMNEPVQEYPDKDPDEQYEGEDNSFDEEFSVDEYIQDDDFNDYGNSYGGDDEEDRKEMPIAIQSSFFESLQNQLDLLALDDKNFLIGQQIIGSLDDDGYLRRPILSLIDDLAFSQNVIAEEEEVLEMLKIVQDFEPAGIGARDLQECLLIQLKKKNNDNEAVKKAIIVVQNYLEEFTKKHYDKLEKALGLNSEELKNIIQEILKLNPKPGDSGAAAGKQLHIIPDFHISNNDGVLHLTLNGRNAPELRVSRSYQEMFEHYEKVEKTDKKMKEAVQFVKQKLDSAKWFIDAIKQRQQTLLKTMNAIMEYQYEYFLTGDDRMLKPMILKDIADRIEMDISTVSRVANSKYVQTEFGTFLLKSFFSEAIQTDSGEEVSNKEVKKILEECISNEDKRKPLADEKLTDILKEKGYSIARRTVAKYREALNIPVARLRKEL

SEQ ID NO: 10041 - protein, 448 aa, Clostridium difficile 630
MNFNNSLELTQSQKLIMTTQLKQSLSILNMSKLELEEEIKREAENNPLVEVEKSGEINWEEYIKDMDRSRRLDRTEISYNPDNEVNLENLVKYSSNLYEDLKFQISLYKLTDKELEVCEYIIDSLDEDGYLRTEEKVIVDTLKIDEELFEKCLISVQQLEPSGVGARSLSECLMIQMASLGIYNEILEEIVTKDLNLIANNKYKEISKKYNMSLQKCVELINIIKTLDPKPGRTCSVEKSVYIQPDVTVEKIDDEFIVYLNEKDSYQIRINSYYKDILKNSQSDESAKEFIKERLNSATGLMKNIESRKTTVLKIAEEIVKAQDEFLRKGTKYIKPLKMKDIAEKLEFHESTISRGVNGKYMLTPFGVYEFRYFFSSAIETENNEMASSTSIKKIIKETIKDENKKKPLSDDHISKLLKEKGINVARRTVAKYREELGIPSSSKRKEY

SEQ ID NO: 10042 - protein, 515 aa, Geobacter bemidjiensis Bem
MAIEMRQQMKMSQQLVMTPQLQQAIKLLQLSRLELQDVVRQELEENPILDEVIEQEEIREPEQIELREKEAEPEAAASDFQEVRAGEETREADWDSYIDGYNYSSGEQYYDDEDRPSFENLLTKKSTLFDHLMWQLSLTRLTEREIVVGAEIIGNIDEEGYLRASLEDVASACVQVAPFQEEMLEWSGLGSDACEEEIADAAGGFSTAVLVPLVDSVLKRIHEFDPVGVGARDLRECLLIQVGSLGMGGSLVESLLRDHLKDLESHKYKQAAKVLGVEVNDILAATRIIAELDPKPGRVFGSDDVQYISADIFVHKVGEEYVVMLNDEGMPNLRINPIYAPDAKSSRPVDKVAEDYIGEKMRSALWLIKSIQQRQRTIFKVAKSIVKFQREFLDRGIEHLRPLVLRDIAEDIGMHESTISRVTTNKYMQTPQGLFELKYFFNSGISTGEGDFIASESVKSKIKELVDNEDSKRPYSDQRLAELLSDHNIVIARRTVTKYREMLRIGSSSERKKHF

SEQ ID NO: 10043 - protein, 484 aa, Hahella chejuensis KCTC 2396
MTPQLQQAIKLLQLSTLDLQQEIQQALESNPMLEVSEEEESPNHVQNDTISDMLANNSSKERAQESGMDEGGFAEEDNWSDSIPNDLPVDTAWDDVFQSGSSSYSGGEDDEYDFESRNSKGETLQDHLLWQLNLTPMSDIDRMIAVAIIDAVNPDGYLSLTPDEIHSGLQTEGEEEIELDEVRAVLKRVQQFDPAGVATCNLQDCLLSQLNQLPKDTPWLGQAKLVVSHYINLLGNRDYAQLMRRSRLKEDDLREVLKLIQSLNPRPGEGIQESNTEYVVPDVIVKKNNGRWLVELNPEIAPKIRINPGYAGLVRRADNSSDNTYLRDQLQEARWFIKSLQSRNETLLKVASQIVEHQQGFLEYGEEAMKPLVLHDIAEAVEMHESTISRVTTQKYMHTPRGVFELKYFFSSHVSTDTGGECSSTAIRAIIKKLVAAESPKKPLSDSKIAALLGDQGINVARRTIAKYREALSIPPSNERKRLI

SEQ ID NO: 10044 - protein, 481 aa, Geobacter sulfurreducens KN400
MAIEMRQQMKMTQQLVMTPQLQQAIKLLQLSRLELQDLVRQEMEENPLLEESLEAEEVKEQDLVELSEKEDAPAPAEQDFREVTTGEETRESDWDSYLEGYNYSSGEQYYDDEDRPSYENILTRKGTLADHLMWQLNMAKLSDEEARASAEIIGNIDEDGYLRATVEEVALACSVSESVAESALKKIQEFDPMGVGARNLRECLLIQVEQLGMAGSVVDGILRNHLHDLETRKYKQIAKSLGVDVDSILMAAKIIAGLDPKPGRVYGSEDVHYISADIFVYKIADDYVVVLNDEGLPNLRISPFYAGEIKNGAAVDAKAEEYINEKSRSAMWLIKSIHQRQRTIYKVAKSIVKFQREFLDRGIEHLRPLVLRDVAEDIGMHESTISRVTTNKYMQTPQGLFEMKYFFNSGISTTEGDFIASESVKNKIKEIVDSEDPRKPYSDQRIAELLSAHTINIARRTVTKYREMLKIGSSSERKRHF

SEQ ID NO: 10045 - protein, 500 aa, Brucella abortus bv. 1 str. 9-941
MALSPKLDIRQSQSLVMTPQLMQSIKLLQMTHIELDQFLDMEIEKNPLLDRIEADSDDLAGGEPASGADDPTESADNDDWFQTEGAGAAENLSATFDNSLENIFPDDLGSSQEQWKLSAGEGAFSGNGYDIDQVTAGRLSLSDYVAEQIVLGFSKAADRFIATALADALDESGYLRIDIVGLAHNLGIETAEIGRILGVLQGFDPPGLFARDLRECLAIQLRLKDRFDPAMEALIANLDLLARRDFATLQKICGVDQADLIDMLAEIRALDPKPGARFEVSVADTIVPDVLVFSARDGGWAIELNPATMPRLIVNNEYYAEVSGSVKTEEKAFLTDCMQTAGWLVRSLDQRARTILKVAQEIVRQQDGFLRHGVAHLKPLNLRMVADAVGMHESTISRVTANKFMATPRGVFELRYFFTASLASSEGGEAHSSESVRHRIRQMIEAEKPDEVLSDDAIVDALKKDGVDIARRTVAKYREAMNIASSVQRRREKKARFSTP

SEQ ID NO: 10046 - protein, 437 aa, Eubacterium yurii subsp. margaretiae ATCC 43715
MNNLELSLKQRLSISNKIITSLEIMSLNIMELYSFLEKESEENVFIDYDSFFEDKLFRDYIKNDNNIIKKDYTTDEEEIEIFDRDKYEPTLFEILLEQLGTSDLSEEEYVVGELIIHSLDHDGYMRDDLGYIAELVHTDVATVEKVLSLIKTFEPVGIGAGNLQECLILQVPEDEVLMRRIIQNHINDLYKNNLDKIAKKENISIEEVKEVFEKIKKLNPRPSIGYKSNNYESMYVYPDIFVEIVSGELKLSFKDSISNIHANKYYLSLLDGDIDDETRAYLKKKLTRTMLIIESINKRKETIEKIAKFIINSQKNHILYNEPLQDLNIKDIATALNLSESTVSRVIKHKHVQTPRHMYKLRNLLSLHCQHTANAVSKNYIMDMIQKMIETEDKKAPLSDERITDMLNDEGISIKRRTVSKYRGKLSIPTAKLRKEY

SEQ ID NO: 10047 - protein, 462 aa, Parabacteroides johnsonii DSM 18315
MQLEQRIKKELEENPALEEGEDEVTVETQNDQDEENIEVKEGDEGAGEDNEFSFEDYLGEDDTPDYRLNTSNYSKDDKFEEIPFSVGSSFQEFLESQLGLRVLTEREKMLATYLIGNIDEDGYLRRKLEAIVDDIAFSLSIKTDEVELRAILDIIQDFDPPGTGARDLQECLLLQIRKRDLDDPYIINAHEILKFHFDEFTKKHYDKILNRMDISEEDLKGAIDEILKLNPKPGGSYSDPLNKTFEQIVPDFILENNDGELELSLNSRNIPELRVSRTYNEMLQSFIAKKDNHSRTEKEAISFVKQKLDSAKWFIDAIRQRQNTLLITMHTILAYQKEYFIEGDERKMRPMILKDIADLTGLDISTISRVANSKYIQTHFGIFPLKYFFSEGLQTDSGEEVSTREIKKILQECVENEDKRKPVTDEKLTDILQEKGYQIARRTVAKYREQLGIPVARLRKEL

SEQ ID NO: 10048 - protein, 509 aa, Rhodospirillum centenum SW
MALQQRLDLRQTQALVMTPQLQQAIKLLQLSNLELSEFVEREIEQNPLLERDDGERWRDAPPDGVDRPEPEAPVPEGRTRDTVELAASDRIAPAADAPLDTDYENVWTNSSQADIREAGDGGEAFGSWSARGGSFEDDEGSLEQTLTGRITLRDHLEQQIVMDMPDPLDRLVARALTDQLDEAGYLTADLAAVAEQLGCPAVRVEAVLARLQKLDPPGIFARSLKECLALQLRELDRLDPCMQALLDNLPLLAGRNIPALLKACQVDAEDLADMVAEIKALNPKPALAFDHAPVQTVVPDILMRPAPGGGWIVELNTDTLPKVLVNQRYYARVSGAARNRTEKEYISERFQQASWLVKSLHQRANTILKVATEIVRQQDAFFLHGLQFLKPLILRDIADAIGMHESTVSRVTTNKFIATPRGVFELKYFFTSAIAGADGQAAHSAEAVRYRIKSLIDAEKPDDVLSDDKLVEILRAEGIDIARRTVAKYREGMKIPSSVQRRREKVLGL

SEQ ID NO: 10049 - protein, 464 aa, Legionella pneumophila str. Corby
MKPTLQIGIGQHLTLTPQLQQAIRLLQLSTFDLQQEIQLVVESNPLLEATPVEEKEDAQINTNQDQDEYSDFQWSQLYNNLNKRNNFEENDYNFDNLHCTTTNLQDHLNWQLDLTPMSDIDRVIATTIIDAINDDGFLTIPVAEIHASLNSDDFPLDIEEIEAVRHRLQLFDPVGCASVNLAETLVLQLEQLPLEPKLLATAKKVILEDIELLGQHNYRQLMKNHQISEKTIHEILQVIHKLNPKPGSLIHQDNIEYVIPDLTVKKIDNQWKVFLNQDILPRLSINSQYAALIQRANNSLDNQFLKHNLQEARWFLKSIQSRQETLLKVATCIMEYQHGFLEFGEEAMKPLILNDVASALDMHESTVSRVTTQKFINTPRGVFELKYFFSSHVNTDSGGECSSTAIRAVIKKLISAENRKKPLSDSKIAQLIGEQGIKVARRTVAKYREAMGIPPSNERKVISS

SEQ ID NO: 10050 - protein, 491 aa, Vibrio harveyi ATCC BAA-1116
MKPSLQLKLGQQLAMTPQLQQAIRLLQLSTLDLQQEIQEALDSNPLLEVEEGHDEPQANGEDKSASESADKSANEANDASEPDLPDSSDVIEKSEISSELEIDTTWDDVYSANTGSTGLALDDDMPVYQGETTESLHDYLMWQLDLTPFSETDRTIALAIIDAVDDYGYLTLSPEEIHESFDNEEVELDEVEAVRKRIQQFDPLGVASRNLQECLLLQLATFPEDTPWLAEAKMVLSDHIDHLGNRDYKLVIKEAKLKEADLREVLKLIQQLDPRPGSRITPDDTEYVIPDVSVFKDHGKWTVSINPDSIPKLKVNQQYAQLGKGNSADSQYIRSNLQEAKWLIKSLESRNETLLKVARCIVEHQQDFFEYGEEAMKPMVLNDVALDVDMHESTISRVTTQKFMHTPRGIFELKYFFSSHVSTDNGGECSSTAIRALIKKLVAAENTAKPLSDSKIAALLADQGIQVARRTIAKYRESLGIAPSSQRKRLL

SEQ ID NO: 10051 - protein, 465 aa, Legionella longbeachae D-4968
MKPSLQLSISQHLTLTPQLQQAIRILQLSTIDLQQEIQLVLESNPLLEATPNEDKEEIAIDETRQQENDQSDFQWSELYQSSDKRTSFDDVDYNFDNLHCTTTNLKDHLKWQLNLSPMSDIDRAIATAIIDAMNSDGFLSMGITELHASLTSEEHPLDLDEIEAVRHRLQLFDPVGCACINLAETLLIQLEQLPQDTEHLALAKKIITKDIELLGQHNYRQLMKNHQITEKTIDSVLKIIQKLNPKPGNLIHEDITEYIIPDLTVKKINNQWQVHLNQSVLPHLSINNQYASLIQRADNSADNLFLKNNLQEARWFLKSIQSRQETLLKVATCIMQYQQGFLEYGEEAMKPLILNDIAIALEMHESTISRVTTQKFIHTPRGVFELKYFFSSHISTNVGEECSSTAIRAVIKKLIAAENRKKPLSDSKITQLLEKQGIQVARRTVAKYREAMGIAPSNERKVIDN

SEQ ID NO: 10052 - protein, 548 aa, Rhodopseudomonas palustris CGA009
MALSQRLEFRQTQSLVMTPQLMQAIKLLQLSNLDLAAFVEDEIEKNPLLDRAGPRTEPPVAGEASAEGAEGGGEFGGSGGEDLGGEGTSDFVDPAGAGAFEPGTEEWMHRDLGSRSDIEQTLDTGMENVFPEEPAEAAARAAQDAAPASYTEWGGGASSDEGYNLEAFVAAESSLADHLAEQLAVAVTTPSQRLIGQYLIDLVDDAGYLPADLGDAAERLGASQAEVEALVQVLQTFDPPGICARNLSECLAIQLRERDRYDPAMQALVEHLDLLAKRDVASLRKICGVDDEDLVDMIGEIRHLDPKPGLKFGSSRVQTVVPDVFVRPGPDGGWLVELNSDTLPKVLVNQSYYSELSKTIRKDGDKSYFSDCLQNATWLVRALDQRARTILKVATEIVRQQDGFFTHGVKHLRPLNLKAVADAIQMHESTVSRVTANKYMATNRGTFELKYFFTASIASADGGEAHSAEAVRHQIRQLIDSEDPSAILSDDTIVERLREAGIDIARRTVAKYREAMRIPSSVQRRRDKQNMLGTQAGAASRSRDTAPA

SEQ ID NO: 10053 - protein, 443 aa, Enterococcus faecalis T8
MKFEQRMSQQQKQVQKLAMTQQLQQSIQILQFNTEELAAFVEAKALENPLIDLQVDTQYTTDFPITSRSYTNQDEENNYMNQIPDYHLSLFESLIDQIHLNYRDTYLRTLVLFLVEYIDVNGYLKISLEEAAEKTEASAIQMLDALTLLQQLDPAGVGARNLQECLMLQTERDDTAPNLAYILLEEEFDALVSRKWGPLAKKFGIELAEIQLIFDYIQTLSPAPGNIFDATEELYIRPDLTVRIKEDRIVVISNKAGRPTLNFQENYFKRMQETDDKEVQEYIKDKKNEFEWLERAVNQRGDTILRVGQEIVRRQEAFFLEADRPLKPMTLKEIADALSIHESTVSRAVNGKYLETTFGVFELRSFFSTSILSSEEDGEDVSTTMVKKQLQKLIDQEVKSKPLSDQKLVERLKDSGMEISRRTVAKYREALGIPSSSKRKRYE

SEQ ID NO: 10054 - protein, 491 aa, Burkholderia pseudomallei K96243
MSATLALQMRQHLALTPRLQQSLRLLQLSSLEFQQELRQALDTNPFLEDVQSPDDDAAEAGPKPGETPAADANARADDGYAERDEGPFATDASPPAGQDVPLTAELSARGSSRRSDDASDLEPGDWMTAEPTLHEHLHDALRLCQLTRRDRTLARMIIDALDDDGYLRQALPELAAAADPLLHPAEQELLVALRLVQSLDQPGIGARTLSECLLLQLDAMPADTPGVECAKEIAAHHLERLARRETAEMQRRIGCDTHTLRIACALVRRLDPRPGNQYGSTAGNYVVPDVIVRQVRNDWLVTINPAVMPRARIHRRYAELFAQSSGSNQSPLGQQLQEARWLIRNAQKRFDTIRRVGECIVERQRDFFRYGEIALKPLVLRDIADELGLHESTISRATGNKYMSTPHGTFEFKHFFPRKLEAAGKGACSAAVARVLIRDMIAAEQAIDPLSDVALAQRLAGRGIVLARRTVTKYRQAMKIPPAELRRRAPL

SEQ ID NO: 10055 - protein, 447 aa, Listeria monocytogenes EGD-e
MRLESNFVQKQQQKQSQKLNMTQQLSQSIAMLQFATADLVAFLEDKALENPLIEVIPGSDFATDFSYSSRKSAGSSDDTDWLEQIADNKMTLADALKEQLHLMDVTQTQKIIVLYLIESLNDNGYLQIDLKDVSAALLMDDSSVLEGLEILQSMEPAGVGARDARECILLQIERSPDAPYIAYDVIQKFFTEFAEKKWKKIASEMDVSLQDIQEVSDYIQTLNPKPGSEFESERVQYVVPDLILLQHEDEFAVSLAKQFLPQVRFQEAYYETMRATEEKDVAQFLREKAGEFDWIKKGIEQRESTLQRVGEAIVSHQKAYFLDNSAHLQPLTLKEVAEELGVHESTVSRAVNGKYMETTNGVYELKRFFASGLQKKSSENENIGDISSTTIKKLVQEFVAAEDKLKPLSDQKIVDMLAEKEIQVSRRAIAKYRLELNIPSSSKRKRF

SEQ ID NO: 10056 - protein, 414 aa, Helicobacter pylori J99
MAILRANLSPKNKLNATLKGWLPILQSELEDLEEVLKQNALDNPLIKIENKRIKNFSDRFNTKKSSDHLENCATASKSLFETLESQIIPPLFPTETSQKIAMDIISGLNNEGYFEENIEERAKVLGVESEVYEKVRKRFSYLNPAGIGAKDVKEGFLFQLDGRELDNNELYEETRKIILNLEKHHEFSKDFYYEKALKILKSFKNPPAIEFLEKEIEVIPELFILEVDNEMIVRLNDESYPTISLEENRFKDSDYLKEKLKEAKDLIDALNLRKATIYKIGLMLLEYQYDFFKGKELRPLKLLDLANEFNHSVSTISRAISNKYLACERGVFPIKHFFSIALDNSETSNAVIKDYLLELIKNEDKKEPLSDAKILELIEEKFHLKMVRRTITKYRQLLNIASSSERKRLYLMRA

SEQ ID NO: 10057 - protein, 477 aa, Serratia symbiotica str. Tucson
MKQGLQLRFSQQLAMTPQLQQATRLLQLSALELQQEIQLALESNPLLEQSDLHDEIDTTASKDIEGLDTREALEQKEIPEELPLDATWDEFYTASSSSGTSTDYSDDERLLYQGETTQTLQDHLMWQLGLTPFSDTNSAIATSIIDAVNNTGYLTVPLEEILESMGDETVTMAEVEAVLKRIQRFDPVGVAARDLRDCLLVQLSQYAKGTPYLAEARLVISEHLDLLANHDFRSLMRSTRLKEDTLKEVIALIQSLDPRPGQSIITDESEYVIPDVLVRKAQDKWMVELNADSVPHLKINQQYAALGNSSRNEADDQFIRSNLQEAKWLIKSLESRNETLLKVTRCIVDQQQAFFEQGEELMKPMVLADIAQAVEMHESTISRVTTQKFLHSPRGIFELKYFFSSHVNTDSGGEASSTAIRALVKKLITAENPAKPLSDSKLVTLLSAQGIIVARRTVAKYRESLSIPPSNQRKQLV

SEQ ID NO: 10058 - protein, 484 aa, Chlorobium tepidum TLS
MAEMRLQQRQTAQLSAQQVMTNQLLQLPLMQLEQRIYDEVQDNPMLELVEERRQDDGAAGSTQAATADSAEMFDSVSRFERSSMKVRADGGNRETVSAGRTSGSASGGEERFFQAVQHDTLHERLLRDLSLQEGIGEREVRIAAEILGNLDSDGYLTEPLEVIIDGLRQSDIDASEADVREIQQKIWYLDPPGVAVANLRERLLVELSVYEHEHDPEAVGVARTILNEAFDDFMNKRFDRLLKKLNLQKRQLEAAIDVITSLDPHPGEAFFDEGGHYISPDFIVIYENGALTAVLNDRSSLSVRVSDEYREVLAKRKVPKEDRQFMRQKLQRANEFVTALQVRRQTLLKVMEALLVAQAKFFIDGPRYLQPLVMKTIAEQTGYDISTISRAVNGKYVQTRFGVFELKYFFSGAVSTDEGEELSSRIIKQQLRDLIEGENPVEPLSDDRLAELLSGKGVQIARRTVAKYREQMQIPVARLRKKIG

SEQ ID NO: 10059 - protein, 489 aa, Bacteroides vulgatus ATCC 8482
MAQGSRQVQTQAQQQIQTLSPQQILVVKLLELPTVELEERIHSEILDNPALEEGKEMPENEDDNTEYVENEDGNTDSNEDFSLGDYSNEDDIPDYKLQEHNRSKEGVAEEIPFSDAVSFYEILKDQLQMQELTPEQRDIAEYLIGSLDDDGLLRKNMESIMDELAIYRGIYTTEEELNKILEIIQDFDPAGIGARSLQECLLLQIQRKADSPLKQIELDIIGKCCDEFTRKNKERIIQKLGITEEQYNEAVSDLTKLNPRPGSSLGEAMGKNMQQIIPDFIVETYEDDTITLSLNNRNVPELRLSRQFTELLDEHTRNKDNQSKASKDALMFLKQKVDAAQGFINAVKQRQHTLLTTMQAIIDIQRPFFLEGDESLLKPMILKDVAERSGLDISTISRVSNSKYVQTNYGIYSLKFFFSDGYTTEDGEELSVREIKRILKECVDTEDKEKPYTDDELAETLKTKGYPIARRTVAKYRQQLNIPVARLRR

SEQ ID NO: 10060 - protein, 419 aa, Borrelia burgdorferi ZS7
MIKQKLKISQNLNSIQIQTIKILGLNQKELTKLILEESENNECLEIDSNKIFFETLKTYRFKKVFYKEDDMIKNQHDIALEKTQTNTSLKEHLLLQLRIQRINEDEIKIGEILINNLNSKGFHIINPYDLFKKEEKEKVKKTIELIQKFDPIGICVPNIIESLILQAKHHKLETNIIKILEKAELLEKTQKKLKEELKIRSKEFNTALEIIRQKLNPNPTLEFKDPNDTNFYVDPDILIINHNNKFKIKIKEVNIFKKELKRTSENPQKQKKAKWLIESLRYRDEILAKIGIAIYTLQKEFLRRGFKSLRPMNLSILSEKISVSKSTISRAIKNKYLKCEWGTILIKELFSSVGGAKTNEFSKLSIKITVKKLLEANKKMSDKEISVILKSKGISISRRTVNKYRNELKSEKGRTYYGT

SEQ ID NO: 10061 - protein, 383 aa, Hydrogenobacter thermophilus TK-6
MVRGELKTTVKPKLSLSVLLKQDVELLNKNSEQLEQILEEEEKQNPYITHVVKRTPRWFFQEQDKKPKEAVARNSLMEEISKQISLEFDHIDKEIALEILYRCDENGFFKDSIEEIARLYGVSSEYVEDIREFIMTEIEPVGVASRNLEEFIKVQLQEMYPKQVEFHERVLNAIKTGKLDEDVKEAISHLRLKPIEDEGSASAVARVDLLLEHDGENWYIFIQEDFLELQIEEDAHPQDDIEKEKLRRAKNIKLILDIRRRVLRHIGEAIVKRQEGFLLRNEPLKTLTVKEVAESSQVSMSTVSRIINSRYAKTPAGIYPLRFFFVKESKVGMSKEELMRAIKEVLQENTSISDGKVAQMLKGRGIDIARRTVAKYRKLLGLR

SEQ ID NO: 10062 - protein, 473 aa, Bordetella pertussis Tohama I
MTRPALELRPGQHLTLTPQLQQSIRLLQLSSLELEAELSQALAENPLLERDEDPAREEQADPEREASVEADEAPDTELRLDEMPGSGGVLPDDDSDLPQAARPDTLREHLLGQLALTRAAPRDAALCGLLIDELDENGYLDSPLEEILTWLPAEVQADLDELRAALALLQSFDPAGIGARDMAECLQLQLRQPDPARLPEAADAEVLACARRICAQHLPLLATGNVARVREAVQCDEAVVRAAHALIPRLEPRPGRAWTVPAADYAIPDVIVRRTRQGWQAVLNSAVVPRLHVNAVYAQVLGGQRQGGNAGLQAQLQQARWMIRNVEQRFDTILRVAQAIVAHQQAFFTQGPAAMRPLILKDIAGELDLHESTISRATTQKYMLTPFGTLELKRFFGAGVSTDGGDATSATAVQAVIRQMVADEDRAKPLSDSQIMQRLADQGIVIARRTVAKYREALRIAPATLRKAHAAGR

SEQ ID NO: 10063 - protein, 475 aa, Treponema pallidum subsp.pallidum str. Nichols
MQQLVQQQRLVLNQRLVHGLCLLQLSRGDLKTEVLRAVQRNPLLEIRPSSARRTGKACYLSLGDRRERMRARDRFQQLLENQPDKQVDNIRAVLREQVFYQKHEAIVLDLACAFIQMLDDHGFFSISPAIFQNMCGSMPTALQEKIPQAIALIQRLEPQGCAVFNFKESLAVQARLRFERFSDPLYRCVINLLTHHSELLFCSDNMCDGRVSVHALTTQINSMGLCVQKVSSNDVKDILLLIKELHPFPGKCVSNAQRADTNMLLEPDVLITKTAHGFVTQINCTGIPTVVFRNDYCMHSKAAEKNHALKACMHDALSLVSMLSYRERTLLDIAKTIVHYQCGFFDHGPAKLTPLRMTDVAHRTGLSVSTVSRIVRDKWLQYGSQHFSLRYFFSPRVLSTEEYRDRSSLGQNYPSSPHSKVSVKYRISRLIQEVRTQRISLSDRRIAQLLGEQGIKCARRTVNKYRSELRTCSSS

SEQ ID NO: 10064 - protein, 428 aa, Rhodobacter capsulatus SB 1003
MELAQTLSQRQTMQMAGQMLHSLAILGMSSQDLSEHLTEQATSNPFLTYRAPPAFIARGGEDFDAVAAVAAHKPSLMAHVVDQIEMAFTETPDRLLALRFAEALEPSGWLGQSLDSIALAAGVSLSRAESMLAVLQGFEPTGLFARDLSDCLILQAREADILTWEVETLIRNIRLIAENRLSDLADLCDCDIGDIPEIIKQIRHLNPKPGLAFDHQPTPVFPPDLIAVRGAEGWTVELNRATSPTITVREDRFADGTADAKARAERRKALAEARALAQALERRGDTLLRTAAVLVARQSAFLDKGPAHLVPLTLEDVASELGLHASTISRAVSGRMIQTQTRALPLRAFFSRAVSTQGGGEAVSRDSALDFVQRTVGGEDPQNPLSDDAIVTLAERAGLRIARRTVAKYRSTLGLASSYERRRAAAAR

SEQ ID NO: 10065 - protein, 479 aa, Xanthomonas campestris
MKARLQTSLGQQLVMTPQLRQAIKLLQMSTTELEVEIAEAVETNPLLEWADEAAHAASDIAVDSSPSASTEQPQREEVAPAERDEDWSQDELQWTGSGSGGSFDDDESGDAAERVAESETLADHLLWQLHLSPLSPRDRQIGAMLIDALDEDGYLREPLSAILETLALGAAVDEADVLTVLHQIQRFDPVGVGARTLGECLALQLGVLDADTPGRELALQIVAGPLERLPRSGVAGLAHELKRSTADVEQAVQLVRSLDPRPGKQIGDLSQDTYVVPDCVIWRQRGVWRAALAGRAQPKVTIHRGYENLIRSCGESDAGYLRGQLQEARWLLKSLEARGETLLRVVRCLLEHQAGFLEFGAQALRPLTLREIAGELGLHESTISRAIARKYVRTPRGTIALRAFFASGIDTDSGGEASSTAIQAMIRRLIDAENPRKPLSDAKLADLLKTSGVPVARRTVAKYREAMNISASHERVRIA

SEQ ID NO: 10066 - protein, 469 aa, Gluconacetobacter diazotrophicus PAl 5
MTPMSAQPRQEFKQNQGLFMSARMRQSIQILQLSNAELHEFLDAEVEKNPLLERDPTTSAPLAERPGLAAPPPMMRAPGATGDAGRWTSDSGLDDDGTGRLAESAPALRDVMFEQLVLSGCTTTEREIGAHLIAALDPAGRLAGGATDDIAATLQVTLRDVEAIRQRMMRFDPAGLFATSLRECLAAQLQERNRFGPAMARLLDNLDLLARHDLKRLRQACDVSATDLEDMIAELRTLDPKPGAEHGSTLTVIVPDILMEQTAEGGWTLELNPESTPRVVLNSALSTRMSLRAHGAERTYLNDTLTSANWLIRALQQRSMTILRVSTEILRRQEDFLQHGPQALQPLNLRTVAEALNIHESTVSRVTANKYVATPRGVLPLKFFFVAAMTGNDGEIRSNIAIQSVIRRMIQGERPDAVLSDEAISLTLRRQGIDIARRTVAKYREAMGFPNSLQRLQRAAEAAPPPNRR

SEQ ID NO: 10067 - protein, 497 aa, Caulobacter vibrioides
MALSHRLELRQGQGLVITPQLQQAIMLLQLSNIELDAFVEAELERNPLLQRDEGDHEPAVEVEAERDASLTQVDAVADTTAGRELDTPVDDVSPGERATGEGTDAEHAGGQIDWSRAGGGGSFESDEGYERALTDSPTLAAHLRTQLVQAALSPAHNAIAEILIDAVDEGGYLRLDIVELADRLGCALALVEETLSVLQGFEPVGVFARDVRECLALQLKDLNRYDPAMAAMLDHLELLAKRDMAGLRRICGVDDEDLREMIGEIRSLNPRPGAAYHSEPAETLVPDVMVREGLGGMWHVELNTDTLPRVLVDQRYHARVSKGARSDQEKTFVADCMASANWLVKSLDQRAKTILKVASEIVRQQDGFLAFGVEHLRPLNLKTVADAIGMHESTVSRVTSNKYIATPRGVFELKFFFTSAIQSSEGGEAHSAASVRHKIKGLVDAEKCEADVHSDDRIVEILKAAGVDIARRTVAKYREAMRIPSSVERRRLMKEAV

SEQ ID NO: 10068 - protein, 416 aa, Campylobacter jejuni subsp. jejuni CG8486
MLKQKITQAPKTKISQTLRSWLPILQANIEDLKENLDKFAEDNPFLNVQDSIQTHDKGKNYFDSFYKHNVNSAFVDSKGLAKKSVYELLNEQILPPLFPTSKSQELAKKIIECLNEEGYFEHDEEFLKEYSLEEIERVRARFKFLDPVGVGAKDYKEAFLFALENMELDEDIDEFCRMLIMDFENIQNYTKEPLYKEALAVLKRFSTPPFLEYFEDSRIIVPDIFVYKENGEIKVKINDDYYPEISIQTDGLEHDFLSHYIKEAKNLVDALAMRKATLYKIGLMIVEYQYDFFMGKEIKPMTFKDLALDLERNASTISRAVANKYLSCERGLIPLRDFFAFALDEEGETSNVGVKEFVANLVKNEDRNKPLSDSKILELIKEEFKVDIGRRTITKYRKHLNIASSTDRKKLYELEG

SEQ ID NO: 10069 - protein, 477 aa, Pectobacterium atrosepticum SCRI1043
MKQGLQLRLSQQLAMTPQLQQAIRLLQLSTLELQQEIQLALESNPLLEQTDQHDEIESFEKADSDSLDTGEALEQRDMPEELPLDATWDEIYSAGTPSGTGSDYRDEELPIYQGETTQTLQDYLMWQVELTPFSDTDAAIATSIVDAVDNTGYLTVPLGDILDSIGDDDVTLEEVEAVLKRVQRFDPVGVAARDLRDCLLVQLSQFDDSTPRLAEARLIVSDHLDLLANHDFRSLIRVTRLKEEVLKEALALIQSLDPRPGQSINTGESEYVIPDVLVRKVQGIWAVELNTDSVPRLQINQQYAALGNSVRNDSDGQFIRSNLQEARWLIKSLESRNDTLLKVTRCIVEQQKDFFDQGEEFMKPMVLADIAQAVDMHESTISRVTTQKFLHSPRGIFELKYFFSSHVNTDSGGEASSTAIRALVKKLIAAENPVKPLSDSKLTALLSDQGIIVARRTVAKYRESLSIPPSNQRKQLI

SEQ ID NO: 10070 - protein, 469 aa, Bordetella parapertussis 12822
MSHVLQDLRLRQQTTLAPRLQQSIHLLQMSALEFTTTVQQALATNPFLEDADETEAQDDAPAPPAASEPPATSEPPPEPPSYAGDYPTRSAAAQPGVASDAAAWVPATLSLHERLSQALGAYVLSERDRALAEFIVDGLDDDGYLRQELAQLAGVADFDPPPDASEWQAALHLVQQLDAPGLAARDLPECLALQIRACSRLDPAVRDAALAIVAAHLPRLARSDYPGMRRALRCSEPVLRQACGVIRGLDPKPGRRYAHEPPSYVVPDVVVSKQRQQWLVVPNRGAMPHARLHQAYADLFRRARMDERSPMAQELQEARWLVRNVEQRYATIRRVAEAIVQRQQMFFEFGQIALRPLMLREVADELEMHESTVSRATANKYMSTPRGVFEFRHFFSRELSTESGGTCSAAAVRALIREYIDAEDPRMPLSDVTLAKRLAGDGIVVARRTVSKYRLQLRLPAADTRRQYY

SEQ ID NO: 10071 - protein, 493 aa, Ralstonia eutropha H16
MKPSLHVRLSQHLALTPQLQQSIRLLQLSTLELQQEVEQALTENPLLERENDWIESPLRVAADGSVNLQSAPAPAPAEPQGNGEARADGAADDDSYGDSGNGDDYGSSDWSLDDFARRPQGDEDEKTPMQLREAEPTLREYLMEQLTPLKISARDKGLAIFLIESLDDDGYLSASLEEICTELPEELEFEIEEVHAILTLLQSFDPPGVGARNAAECLALQLRRLTHPQRELALNIVTNHLELLAVRDYTRLKKALQVDEAALKSAHELIRSLAPYPGHAYSRPEADFVVPDVFVRKGGGGWIAQLNPDVMPRLRINDMYAQILRGAKGESGTAGLQQKLQEARWLIKNIQQRFDKILRVSQAIVERQKNFFSHGEIAMRPLVLREIADTLGLHESTISRVTTNKYMATPMGTFELKYFFGSHVSTETGGAASSTAIRALIKQLIGAEDPRNPLSDSRIAELLGEQGFVVARRTVAKYREALKIPAVNLRKSL

SEQ ID NO: 10072 - protein, 494 aa, Pseudomonas stutzeri
MGQQLTMTPQLQQAIRLLQLSTLDLQQEIQEALDSNPMLEREEDGDDFDGSDPMAEAVDRSSDAGSEKISTQESTYEEPSHSGEGLDEADWGERIPSELPVDTAWEDIYQTSASSLPSNDDDEWDFTSRTSSGVSLQSHLLWQLNLAPMSDTDRLIATTLIDCINDQGYLEESLQEIVDSFDPELEIELDEVEVVLRRVQQFEPAGIGARDLRECLLLQLRQLPDRTPWLSEAQRLVSDHLDLLGSRDYSLLMRRMKLKEDELRQVIELIQSLNPRPGSQIEASEPEYVVPDVIVRKHNDRWLVELNQDAMPRLRVNAQYASFVKRADSSADNTFMRNQLQEARWFIKSLLSRNETLMKVATQIVEHQRAFLEHGDEAMKPLVLHDIAEAVGMHESTISRVTTQKYMHTPRGIYELKYFFSSHVSTAEGGECSSTAIRAIIKKLVAAENPKKPLSDSKIAGLLEAQGIQVARRTVAKYRESLGIAPSSERKRLL

SEQ ID NO: 10073 - protein, 502 aa, Pseudomonas stutzeri
MKPSLALKMGQQLTMTPQLQQAIRLLQLSTLDLQQEIQEALDSNPMLEREEDGDDFPRTDPMAEAAERPGESGAEKSSSQESTYEEPSHSAESLEDGDWGERIPSELPVDTAWEDIYQTSASSLPSNDDDEWDFTSRTSTGISLQSHLLWQLNLAPMSDTDRLIATTLIDCINDQGYLDESLQEIVDSFDPELEIELDEVEVVLRRIQQFEPAGIGARDLRECLLLQLRQLPERTAWLNEAQRLVSDHLDILGSRDYSLLMRRMKIKEDELRQVIELIQSLNPRPGSQIEASEPEYVVPDVIVRKHNDRWLVELNQEAMPKLRVNAQYAGFVKRADSSADNTFMRNQLQEARWFIKSLLSRNETLMKVATQIVEHQRAFLEHGDEAMKPLVLHDIAEAVGMHESTISRVTTQKYMHTPRGIYELKYFFSSHVSTAEGGECSSTAIRAIIKKLVAAENQKKPLSDSKIAGLLEAQGIQVARRTVAKYRESLGIAPSSERKRLL

SEQ ID NO: 10074 - protein, 489 aa, Vibrio sp. Ex25
MKPSLQLKLGQQLAMTPQLQQAIRLLQLSTLDLQQEIQEALDSNPLLEVEEGQDEPVANGEDKSAVEAADSNSANEPADIDVPDSSDVIEKSEISSELEIDTTWDDVYSANTGSTGLALDDDMPVYQGETTESLHDYLMWQLDLTPFSETDRTIALAIIDAVDDYGYLTLSPEEIHESFDNEEIELDEVEAVRKRIQQFDPLGVASRNLQECLLLQLATFPEDTPWLAEAKMILADHIDHLGNRDYKLVIKETKLKEADLREVLKLIQQLDPRPGSRITPDDTEYVIPDVSVFKDNGKWTVSINPDSVPKLKVNQQYAQLGKGNSADSQYIRSNLQEAKWLIKSLESRNETLLKVARCIVEHQQDFFEYGEEAMKPMVLNDVALAVDMHESTISRVTTQKFMHTPRGIFELKYFFSSHVSTDNGGECSSTAIRALIKKLVAAENTAKPLSDSKIAALLADQGIQVARRTIAKYRESLGIAPSSQRKRLL

SEQ ID NO: 10075 - protein, 545 aa, Bradyrhizobium sp. BTAi1
MALTQRLEFRQSQSLVMTPQLMQAIKLLQLSNLDLSTFVEEELERNPLLERANDGPEAPVAGEQQMSERSEFSDAGEAGGEDFGDGGGAAGESFDGAPEDWMSRDLGTRTEIEQTLDTGLDNVFSEEPAETAARNAQDAAPTTYTEWGGGASGDEDYNLEAFVAAETTLSDHLAEQAAVAFTAPADRMIGQYLIDLVDEAGYLPADLGQAADRLGAEQADVDAVLGVLQTFDPPGICARNLSECLAIQLRELDRYDPAMQALVEHLDILAKRDFASLRKLCGVDDEDLVDMIGEIRRLDPKPGLKFGTTRTQTMVPDVYVRPGPDGGWLVELNSDTLPRVLVNQVYYSELSKTIRKDGDKSYFTDCLQNATWLVRALDQRARTILKVATEIVRQQDGFFTHGVAHLRPLNLKAVADAIQMHESTVSRVTANKYMATNRGTFELKYFFTASIASADGGEAHSAEAVRHHIKQLIDAEDPSAILSDDTIVEKLRAAGIDIARRTVAKYREAMRIPSSVQRRRDKQSMLAHALSGPAGADRTRDTASV

SEQ ID NO: 10076 - protein, 497 aa, Pseudomonas syringae pv. tomato str. DC3000
MKPSLVLRMGQQLTMTPQLQQAIRLLQLSTLDLQQEIQEALESNPMLERQEEGDDFDNSDPLADNIEQKPNPDVQEPTYQESAPTVDNLEDGEWSERIPNELPVDTAWEDVYQTSASSLPSNDDDEWDFTTRTSAGESLQSHLLWQLNVAPMSDKDRLVAVTLIDCINNQGYLDETLEEILESFDPELDIELDEIEAVLHRIQQFEPAGIGARNLSECLLLQLRQLPAKTPWLTEAQRLVTDYIDLLGSRDYGQLMRRMKLKEDELRQVIELVQSLNPRPGSQIESTEAEYVIPDVIVRKDNERWLVELNQESVPRLRVNPQYAGFVRRADTSADNTFMRNQLQEARWFIKSLQSRNETLMKVATQIVEHQRGFLEYGDEAMKPLVLHDIAEAVGMHESTISRVTTQKFMHTPRGIYELKYFFSSHVSTSEGGECSSTAIRAIIKKLVAAENQKKPLSDSKIAGLLEAQGIQVARRTVAKYRESLGIAPSSERKRLM

SEQ ID NO: 10077 - protein, 488 aa, Azotobacter vinelandii
MTPQLQQAIRLLQLSTLDLQQEIQEALDSNPMLERQEDAEDYDSPDMLGEHGDQSTLDTTPGSYQEGYESGAASEDGGTLEEGDWHERIPSELPVDTAWEDIYQTSASNLPSTDEDEWDFTTRTSTGESLQSHLLWQLNLTPMSDTDRLIAVTLIDSINSDGYLEAALEEILASLDPELGVELDEVEMVLRRIQQFEPAGIAARDLSESLLLQLRQLPPDTPWLEEAKRLAKDYLDLLGNRDFTQLMRRMKLKEEELRPVIELIQSLNPRPGAQIESSEPEYVVPDVIVRKHNDRWLVELNQEAVPRLRINPHYAGFIRRADASADNTFMRNQLQEARWFIKSLQSRNETLMKVSTQIVEHQRGFLDYGEEAMKPLVLHDIAEAVGMHESTISRVTTQKYMHTPRGIYELKYFFSSHVSTAEGGECSSTAIRAIIKKLIAAENPKKPLSDSKIAGLLEEQGIQVARRTVAKYRESLSIAPSSERKRLM

SEQ ID NO: 10078 - protein, 444 aa, Bacillus megaterium DSM 319
MQLGLDLSQKQLLKLAMTPELRQSINILNYSTADLVHYLHQQVNENPVIKLSAGDSQQKDSFDTREQRSYSKGYTDDEYNPFNYISDQTVTLESHLLEQLSMLNHLHTHQKHIVQFLIGNLNKNGFLAIEPKLAAELLNVSINEVNDMIHVLQSFDPLGVGAQNFVDSLLIQIKAKKSKPPLLYDVVKHDIEDIANKKYRNISKKYSISMREVQEIVDCLRTLNPRPAGDFHVPLTKYISPDVTVQKVDGRYHVILHSELLPPIEINGTYQKLVHRSACVTTDRYVQEKIHEATWLINSIEQRNATIYNVSKAIVEHQQDFFEMGISGLKPLTLKDIAQKIDCHESTVSRATNGKYIQTPRGLFELKYFFTNSLERTDGEQSNSTAFIKEKIKTLIAEENKLKPLSDQKLMSLLSSEGIQISRRTVAKYREEAGIESSSKRRRF

SEQ ID NO: 10079 - protein, 485 aa, Edwardsiella tarda EIB202
MQLRLSQQLAMTPQLQQAIRLLQLSTLELQQEIQQALESNPLLEQLEPNDEADGDSADDERVQDDADARDDDDPLDTRDALEQREMPDELPLDASWDEIYTAGTPSGTGTDYHDDELPVFQGETTQTLQDYLMWQVELTPFSETDLAIATAIVDAVDDTGYLTASLEEILESLGDEHALPEEVEAVLKRIQRFDPVGVAARDLRDCLLVQLSQFAPDTPYLNEARSIVDRHLDLLGNHDFRNLMRSTKLKEEVLKEAMQLIQSLDPRPGLSINTGESDYVIPDVLVHKHQGRWVVELNQDSVPRLHINQRYAALGAQARSDSDSQFIRSNLQEAKWLIKSLESRNDTLLKVSRCIVEQQQAFFEHGAESMKPMVLADIAQQVEMHESTISRVTTQKFLHSPRGIFELKYFFSSHVNTEDGGEASSTAIRALVKKLIAAENPAKPLSDSKLTTLLADQGIMVARRTVAKYRESLSIPPSNQRKQLV

SEQ ID NO: 10080 - protein, 477 aa, Klebsiella pneumoniae 342
MKQGLQLRLSQQLAMTPQLQQAIRLLQLSTLELQQELQQALESNPLLEQTDLHDEVEAKEVEDRESLDTVDALEQKEMPDELPLDASWDEIYTAGTPSGNGVDYQDDELPVYQGETTQTLQDYLMWQVELTPFTDTDRAIATSIVDAVDDTGYLTIQIEDIVDSIGDDEIGLEEVEAVLKRIQRFDPVGVAAKDLRDCLLIQLSQFAKETPWLEEARLIISDHLDLLANHDFRTLMRVTRLKEEVLKEAVNLIQSLDPRPGQSIHTSEPEYVIPDVLVRKVSGRWTVELNADSIPRLKINQQYAAMGNSARNDADGQFIRSNLQEARWLIKSLESRNDTLLRVSRCIVEQQQAFFEQGEEYMKPMVLADIAQAVEMHESTISRVTTQKYLHSPRGIFELKYFFSSHVNTEGGGEASSTAIRALVKKLIAAENPAKPLSDSKLTSMLSEQGIMVARRTVAKYRESLSIPPSNQRKQLV

SEQ ID NO: 10081 - protein, 489 aa, Vibrio fischeri MJ11
MKASLQLKMGQQLAMTPQLQQAIRLLQLSTLDLQQEIQEALDSNPLLDVEEEALSTPETLTSPEPQAEKETASAEQETPVTDSSDVIESNNISEELEMDASWDDVYSANSGSTGLAIDDDTPIYQGETTESLQDYLMWQADLTPFTDLDRTIATTIIESLDEYGYLTSSLDDILESIGDEEVEMDEVEAVLKRIQQFDPLGVASRDLAECLLLQLATYPADTPWLPETKLILKDHINLLGNRDYRQLAKETKLKESDLKQVMMLIHELDPRPGNRVIDTETEYVIPDVSVFKHNGKWVVTINPDSVPRLKVNAEYAALGKTMGNTPDGQFIRTNLQEAKWLIKSLESRNETLLKVARCIVEHQQDFFEYGEEAMKPMVLNDIALDVDMHESTISRVTTQKFMHTPRGIFELKYFFSSHVSTDNGGECSSTAIRALVKKLVAAENQAKPLSDSKIATLLAEQGIQVARRTIAKYRESLGIAPSNQRKRLL

SEQ ID NO: 10082 - protein, 458 aa, Bacillus thuringiensis str. Al Hakam
MGVCDRILLLPNLLYNRNKGEISLKASLLQEQSLRLAMTQELRQAITMLQYNVQELSEFLYEQSLENPLIELGGFEREKKKSSNNSKSTSKQVENQMEIYSVDSTTIQQHLLNQIQYYKIEEEERKVASFIIMNMDGNGYLQETNEELANLLSAPLHVVDRSVELVQSLEPAGVGARNIQECLTLQLKRLQRRNGLAEEVVEDHFAYFVKKDWRKLVQVLKCSNEELQDAVNCITSLQPKPGLAFSSDKPLYIVPDMAVKKDGDRLVLQMNERNMPRIEIHSEYSALLNNSESEVASYVSEKYQHVQWIMRSLKQRKQTLLQVMTIIMEKQRDFFWKGPEYLKPLALKEVAEELSVHESTISRATRNKYVQTPHGLFEMKSFFSNAVSTTEDEAVSTKRVKQFIQTLVEAENKKKPLSDQKISKLLEEEHEIVISRRTVAKYREQMHIPASSLRKTIG

SEQ ID NO: 10083 - protein, 505 aa, Colwellia psychrerythraea 34H
MRPTLQLRIGQHLTMTPQLQQAIKLLQLSTLELQQEIQEVLESNPLLELDEKAQSDNSSEQNNLEEAFSSNTNEEKTDQPAGDGSEEQQASIDEISTTEAMEKSDIPEELNIDTTWEESYSAGVSNTGAVSSPADDYTYQGETTDSIQDHLLWQMELTPFSDTDKTIAIAIIEAVDDAGYLTVSPEDILESVGTEGLELDEVEAVLKRINMFDPIGVAARSIPDCLLIQLNQFSADTPYLKESKLIINDHIDLLGNRDYRQLMRKTKLKEDQLREVMRLIQSLNPRPGDAVIKGDDQYVIPDVSVEKKNGRWVVELNSDTAPKLSINKQYAAMSKTMKSSTDDGQFIRSNLQEAKWFIKSLESRNDTLLKVSNCIVQRQQGFLEHGAEAMRPMVLNDIAEAVDMHESTISRVTTQKYMHTPRGIFELKYFFSSHVSTENGGECSSTAIRSLIKKLILAETPAKPLSDSKMANLLAEQGIKVARRTIAKYRESLAIPPSNQRKSLL

SEQ ID NO: 10084 - protein, 477 aa, Shigella flexneri 2a str. 301
MKQGLQLRLSQQLAMTPQLQQAIRLLQLSTLELQQELQQALESNPLLEQIDTHEEIDTRETQDSETLDTADALEQKEMPEELPLDASWDTIYTAGTPSGTSGDYIDDELPVYQGETTQTLQDYLMWQVELTPFSDTDRAIATSIVDAVDETGYLTVPLEDILESMGDEEIDIDEVEAVLKRIQRFDPVGVAAKDLRDCLLIQLSQFDKTTPWLEEARLIISDHLDLLANHDFRTLMRVTRLKEDVLKEAVNLIQSLDPRPGQSIQTGEPEYVIPDVLVRKHNGHWTVELNSDSIPRLQINQHYASMCNNARNDGDSQFIRSNLQDAKWLIKSLESRNDTLLRVSRCIVEQQQAFFEQGEEYMKPMVLADIAQAVEMHESTISRVTTQKYLHSPRGIFELKYFFSSHVNTEGGGEASSTAIRALVKKLIAAENPAKPLSDSKLTSLLSEQGIMVARRTVAKYRESLSIPPSNQRKQLV

SEQ ID NO: 10085 - protein, 505 aa, Myxococcus xanthus DK 1622
MAMELKQSLKLAQQLVMTPQLQQAIKLLQLSRMELLEQVREEMEQNPLLEQPDEQAPGDVGDKEPGEASLEADNMEVPRDVDLPAATSDTATEFKADGEGPPEIDWEQYLNSYQFNEPTTASNKGNVATDDMPSFEANLVKKADLVDHIQEQLGTLRLNDAERRIAMLILGNLDDDGYLKLPEVDGDPLIRLANEADVPMHVAERTLRRIQMLDPRGCGARDLQECLLIQLQGIREPHAPLLGLIIKRHMKYLESKNLPAIAKDLKVTLEEVVGAVRLLPKLDPKPGRNFSGDDAQYISPDVFVYKMGDDYTVVLNDDGLSKLRISGTYRNALKTGAVGPGQTKDFIQDKLRSAMWLIRSIHQRQRTIYKVTESIVKFQRDFLDKGIAYLKPLILRDVAEDIGMHESTVSRVTTSKYVHTPQGIFELKYFFNSSIARVSGEDTASEAVKHHIKQLVAQEDARNPYSDQKIVELLRSQGTEIARRTVAKYREVLGILPSSKRKRYY

SEQ ID NO: 10086 - protein, 435 aa, Bacillus cereus AH1134
MKASLLQEQSLRLAMTQELRQAITMLQYNVQELSEFLYEQSLENPLIELGGFEREKKKSSNNSKSTSKQVENQMEIYSVDSTTIQQHLLNQIQYYKIDEEERKVASFIIMNMDGNGYLQETNEELAELLSAHIHVVDRSVELVQSLEPAGVGARNIQECLTLQLKRLQRRNGLAEEVVEDHFAYFVKKDWRKLVQVLKCSNEELQSAVNCITSLQPKPGLAFSSDKPLYIVPDMAVKKDGDRLVLQMNERNMPRIEIHSEYSALLNNSESEVASYVSEKYQHVQWIMRSLKQRKQTLLQVMTIIMEKQRDFFWKGPEYLRPLALKEVAEELSVHESTISRATRNKYVQTPHGLFEMKSFFSNAVSTTEDEAVSTKRVKQFIQTLIGAEDKKKPLSDQKISKLLEEEHEIVISRRTVAKYREQMHIPASSLRKTIG

SEQ ID NO: 10087 - protein, 436 aa, Bacillus subtilis subsp. subtilis str. 168
MDMKLQQVQVLKPQLTQELRQAITLLGYHSAELAEYIDELSLENPLIERKETDTPPLSYHKTNKNRMNAQEAGLQLSNPQKTLQDALKQQSLDMNLTNTEKKIFNYLIHSLDSNGYLEEDIEEAARRLSVSAKEAEAVLAKLQSLEPAGIGARSLQECILLQLQRLPNRNEQAEMLVSAHFDAFAQKKWKTLSVETGIPLHTIQDISDDIAALHPRPGLLFARPEQDVYIEPDIFITVKNGHIAAELNTRSFPEIDLHPQYRTLLSSGSCQDTVSYLSAKYQEWRWLSRALRQRKQTITRIINELITRQKDFFLKGRSAMKPLTLREVADCLSLHESTVSRAIKGKTIQTPYGLFEMKLFFSAKAEASGDGDASNYAVKTHLENLINQEDKTKPLSDQKLVDLLYEQHGIQISRRTVAKYRDQMNIPSSAARKRYK

SEQ ID NO: 10088 - protein, 445 aa, Bacillus clausii KSM-K16
MEIGLLQRQTTSLVMTQELRQALHLLQYSSVDVIAYLREQALENPLLELHEQSTLSRERELVGTRPIRQPMSSDDKQAALQNVAQRGRTLADELYEQLIESPTLSENDKCELTYLIGNLREDGYLGEALPQLCADRNITESEGERLLAILQSFEPAGVGARSLGECLALQLKRMPDCHPLAIDIVLNHLEALAARKWKQLAKQYGVAVQDIQHLYDQLKELDPKPGLRYSKETAIYVQPDVLMAKDESGKLLVFMNDDILPAIRVHEEYDHLLKQQVETSAYAKQKRQHVEWLKRSLEQRQQTVRRVAEVLASMQADYLLQPSGVLKPLTLNDVAQVLGIHESTVSRATANKYAQTPRGLVELKTLFSGHVSKSDAQLTNHHVKVWLKEMISVEDKSKPLSDQKLAEQLRIDKGVALSRRVVAKYRDELGILPSSKRKRYNERTG

SEQ ID NO: 10089 - protein, 503 aa, Ralstonia pickettii 12J
MKQSLQLRLSQHLALTPQLQQSIRLLQLSTIELQQEVEQALTENPLLERENEWLDTSARIGADGSLNALQSNSATPLPTESPPPAPNGGDSSDSSDSSYENGHDNGADFDSDYGSDRSDWSLDDFARKPQSDEDDRAPLQLREAEQSLREFLMEQLAPLKLSMRDKGLVIFLIESLDDEGYLSGTLDEILADLPPELEVELDELQAALRMLQSFDPPGIGARSAAECLSLQLHRLDSPAKGLALIIVNQHLELLAARDYTRLKKALCVDEPTLKAAHELIRSLAPFPGHAFGRAEADFVVPDVIVRKTSAGWMAQLNPDVMPRLRINDMYAQILRSSRGESGAANLQQKLQEARWLIKNIQQRFDTILRVSQAIVERQKSFFTHGEIAMRPLVLREIADTLGLHESTISRVTTNKYMATPMGTFELKYFFGSHVSTETGGAASSTAIRALIKQLVGAEDPKNPLSDSRIAELLGEQGFVVARRTVAKYREALKIPAVNLRKSL

SEQ ID NO: 10090 - protein, 493 aa, Ralstonia eutropha H16
MKPSLQLRLSQHLALTPQLQQSIRLLQLSTLELQQEVEQALTENPLLERENDWIESPLRVAADGSVNLQSAPAPAPAEPQGNGEARADGAADDDSYGDSGNGDDYGSSDWSLDDFARRPQGDEDEKTPMQLREAEPTLREYLMEQLTPLKISARDKGLAIFLIESLDDDGYLSASLEEICTELPEELEFEIEEVHAILTLLQSFDPPGVGARNAAECLALQLRRLTHPQRELALNIVTNHLELLAVRDYTRLKKALQVDEAALKSAHELIRSLAPYPGHAYSRPEADFVVPDVFVRKGGGGWIAQLNPDVMPRLRINDMYAQILRGAKGESGTAGLQQKLQEARWLIKNIQQRFDKILRVSQAIVERQKNFFSHGEIAMRPLVLREIADTLGLHESTISRVTTNKYMATPMGTFELKYFFGSHVSTETGGAASSTAIRALIKQLIGAEDPRNPLSDSRIAELLGEQGFVVARRTVAKYREALKIPAVNLRKSL

SEQ ID NO: 10091 - protein, 514 aa, Agrobacterium tumefaciens str. C58
MALSASLLLRQNQSLVMTPQLMQSIQLLQMTHFELTQFIAQEVERNPLLEIAANDGDLGSDTPVDVDNFGDAEASDAAVRVTPDSDDWYGERAANLGEQLDTSFENVFPDDGEPRKADAPELASQWKSMPGQESGESYDLDDFVAARQSLSDHLNQQLPLAISAAEDRMIADALIGQLDETGYIAADAVDDVAERLGATPSAVEYVLKTLQGFDPPGIFSRSLSECLATQLAQKDRLDPAMRAFVDNLELLAKRDFASLKKLCGVDEEDLLDMLAEIRTLNPRPGAGYDSMVSETIVPDIIVRPSSTGGWLVEINPDTLPRVLINQSYFAEVSKHKARAGEDQDFLSECMQTAHWLTRSLDQRARTIMKVASEIVRQQDAFLINGVDQLRPLNLKTVADAIKMHESTVSRVTSKKYMLTPRGLFELKYFFSVSISAVEGGDSHSAEAVRHRIKAMIAQEAAEAVLSDDDIVDNLKKTGIDIARRTVAKYREAMNIPSSVQRRREKKAMAKLSAF

SEQ ID NO: 10092 - protein, 485 aa, Candidatus Cloacamonas acidaminovorans
MSAMEQYLSLKQKQELALKPKMLQSLKMLALPILELESYIKQELVNNPLLELREEKDEDDIDESNFEQSTPESSTPIEESDMSENHLETLAEAEELTEILDTWNEYHSSYEGWSSDSETDHTEALIRYEENGKEKFLEQLFPLELPENEIDFITDIVDSCDSYGFLPKGFNIVNLAKKYLITAERAEGLHNIILSLSPKGISARNITECLMAQLTEEQKQNRILVGLVSEHFENLIHRRYQKIASAYGVSEETILLAKEQISKLDPKPGLRILSTSAVYVFPDVTMKLIDGKYEIIINDHITPNIIISPRYRKMINRGYFDKETMQYVRERINSAKFLIKSIYMRMRTLERVSLSIINHQYDFFYLGTGQMKPLTYAVIARDLGVNESTISRVVKHKYAETPYGIYAFKDFFTSTAGFDDDYQSVSRQKVKTHLIRLIETEDKKKPYSDQELVELLKAEGLNISRRIITKYRDELGILNSHLRRQ

SEQ ID NO: 10093 - protein, 487 aa, Gramella forsetii KT0803
MLKQQLNFKLSQKLSPQQIQLMKLIQLPTQAFEQRIKEEMEENPALEDGKEERIDEYDDIGNENSEDDYDNDNETIETEIDVDEYLSDDEIPSYRLNANNYSPDDDDKQVPYAAGTSFTQHLKTQLSTFRFEETEHEIAEFLVGSVDESGYIRRAVQDIVDDLAFTQNIYTDEATVEKVLDKVQQLDPAGVGARSLEECLLIQLTRKESTKQVELAKDIMERSFDHFSKKHYKKLLSRHDISEDELREAIEVIEHLNPKPGGAYSGNTRMVEHVIPDFTIKIEDGELQLTLNGRNAPEMHISRDYNNMLKGYKESKEKTKAQKDAVMFIKQKLDAAKWFIEAIKQRQQTLMVTMSSIMNYQKEYFLTGDERNLRPMILKDIADEIEMDVSTVSRVANSKYVDTPYGTKLIKEFFSESMTNDQGEEVSTREIKKILEMSIEEEDKRKPLTDEKLAKVLKDKGYPIARRTVAKYREQLDISVARLRKEI

SEQ ID NO: 10094 - DNA, 28 bp, Artificial Sequence
  Synthetic sequence
gcagcatatgaaaccatcgctcgtccta

SEQ ID NO: 10095 - DNA, 31 bp, Artificial Sequence
  Synthetic sequence
gcaggaattcctacatcagtcgcttgcgttc

SEQ ID NO: 10096 - DNA, 39 bp, Artificial Sequence
  Synthetic sequence
cgtacggttgccaaggctcgtgagatgctgggtattccg

SEQ ID NO: 10097 - DNA, 39 bp, Artificial Sequence
  Synthetic sequence
cggaatacccagcatctcacgagccttggcaaccgtacg

SEQ ID NO: 10098 - DNA, 41 bp, Artificial Sequence
  Synthetic sequence
ggaaacagaccatgcaattccagctcggtacccggggatcc

SEQ ID NO: 10099 - DNA, 41 bp, Artificial Sequence
  Synthetic sequence
ggatccccgggtaccgagctggaattgcatggtctgtttcc

SEQ ID NO: 10100 - DNA, 34 bp, Artificial Sequence
  Synthetic sequence
gagccctagggcatgcatttacgttgacaccatc

SEQ ID NO: 10101 - DNA, 33 bp, Artificial Sequence
  Synthetic sequence
gagccctaggtcagagctcaatgcggcgttcac

SEQ ID NO: 10102 - DNA, 195 bp, Artificial Sequence
  Synthetic sequence
catatgctgacccaaggcgaactgatgaaactgatcaaagaaatcgtggagaatgaggacaagcgtaaaccgtacagcgatcaggagatcgcgaacattttgaaagagaagggtttcaaggtcgcacgccgtacggttgccaagtatcgtgagatgctgggtattccgtccagccgtgaacgccgcattgagctc

SEQ ID NO: 10103 - protein, 64 aa, Artificial Sequence
  Synthetic sequence
MLTQGELMKLIKEIVENEDKRKPYSDQEIANILKEKGFKVARRTVAKYREMLGIPSSRERRIEL

SEQ ID NO: 10104 - DNA, 11 bp, Artificial Sequence
  Synthetic sequence
gttggcacgtt

SEQ ID NO: 10105 - DNA, 41 bp, Artificial Sequence
  Synthetic sequence
gagcggataacaattgttggcacgttcacacaggaaacagc

SEQ ID NO: 10106 - DNA, 41 bp, Artificial Sequence
  Synthetic sequence
gctgtttcctgtgtgaacgtgccaacaattgttatccgctc

SEQ ID NO: 10107 - DNA, 11 bp, Artificial Sequence
  Synthetic sequence
gttggtacatt

SEQ ID NO: 10108 - DNA, 41 bp, Artificial Sequence
  Synthetic sequence
gagcggataacaattgttggtacattcacacaggaaacagc

SEQ ID NO: 10109 - DNA, 41 bp, Artificial Sequence
  Synthetic sequence
gctgtttcctgtgtgaatgtaccaacaattgttatccgctc

SEQ ID NO: 10110 - DNA, 11 bp, Artificial Sequence
  Synthetic sequence
gttggcccatt

SEQ ID NO: 10111 - DNA, 41 bp, Artificial Sequence
  Synthetic sequence
gagcggataacaattgttggcccattcacacaggaaacagc

SEQ ID NO: 10112 - DNA, 41 bp, Artificial Sequence
  Synthetic sequence
gctgtttcctgtgtgaatgggccaacaattgttatccgctc

SEQ ID NO: 10113 - DNA, 11 bp, Artificial Sequence
  Synthetic sequence
gttcccacgtt

SEQ ID NO: 10114 - DNA, 41 bp, Artificial Sequence
  Synthetic sequence
gagcggataacaattgttcccacgttcacacaggaaacagc

SEQ ID NO: 10115 - DNA, 41 bp, Artificial Sequence
  Synthetic sequence
gctgtttcctgtgtgaacgtgggaacaattgttatccgctc

SEQ ID NO: 10116 - DNA, 20 bp, Artificial Sequence
  Synthetic sequence
gttggcacggccgttgctta

SEQ ID NO: 10117 - DNA, 51 bp, Artificial Sequence
  Synthetic sequence
gagcggataacaattgttggcacggccgttgctattcacacaggaaacagc

SEQ ID NO: 10118 - DNA, 51 bp, Artificial Sequence
  Synthetic sequence
gctgtttcctgtgtgaatagcaacggccgtgccaacaattgttatccgctc

SEQ ID NO: 10119 - DNA, 20 bp, Artificial Sequence
  Synthetic sequence
gttggcacagatttcgcttt

SEQ ID NO: 10120 - DNA, 50 bp, Artificial Sequence
  Synthetic sequence
gagcggataacaattgttggcacagatttcgctttcacacaggaaacagc

SEQ ID NO: 10121 - DNA, 50 bp, Artificial Sequence
  Synthetic sequence
gctgtttcctgtgtgaaagcgaaatctgtgccaacaattgttatccgctc

SEQ ID NO: 10122 - DNA, 19 bp, Artificial Sequence
  Synthetic sequence
ttaggcctgaatgccggtg

SEQ ID NO: 10123 - DNA, 22 bp, Artificial Sequence
  Synthetic sequence
atgtacgcagtgattgttaccg

What is claimed is:

1. A method for repressing transcription or gene expression from a binding site of interest, wherein the binding site of interest is an RpoN binding site or a cryptic promoter upstream or downstream of an RpoN binding site, comprising the steps of:
    (a) providing an agent wherein the agent:
        (i) specifically and selectively binds to a sequence comprised in the binding site of interest,
        (ii) inhibits or represses expression of genes regulated by the binding site of interest, and
        (iii) comprises a heterologous protein comprising a sequence selected from the group consisting of SEQ ID NOS. 10000-10093; and
    (b) contacting the agent to the binding site of interest.

2. The method of claim 1, wherein said contacting comprises contacting the agent to a bacterial cell comprising the binding site of interest, wherein the agent is heterologous to the bacterial cell.

3. The method of claim 1, wherein the agent binds specifically to a −24, −12, or −24/−12 site for RpoN promoter interference.

4. The method of claim 1, wherein the RpoN binding site comprises a sequence selected from the group consisting of SEQ ID NOS. 1-9999 and the 3' to 5' complementary base pairs thereof.

5. The method of claim 1, wherein the agent comprises a $\sigma^{54}$ ("sig54") protein.

6. The method of claim 5, wherein the agent is provided by heterologously expressing the $\sigma^{54}$ ("sig54") protein.

7. The method of claim 1, wherein the agent comprises an RpoN protein comprising a modification to the heptad repeat overlapping the glutamine-rich or acid-rich motifs.

8. The method of claim 1, wherein the agent binds specifically and selectively to the cryptic promoter.

9. The method of claim 1, wherein the agent is a synthetic peptide from 20 to 600 amino acids in length.

10. The method of claim 9, wherein the synthetic peptide comprises at least 20 carboxy terminal amino acids of an RpoN protein.

11. The method of claim 9, wherein the synthetic peptide comprises the conserved amino acids from an RpoN box of Region III of an RpoN protein through the carboxy terminal amino acid residue of the RpoN protein.

12. The method of claim 9, wherein the synthetic peptide has 70-75%, 75-80%, 80-85%, 85-90%, 90-95% or 95-100% homology with an RpoN box of Region III of an RpoN protein.

13. The method of claim 11, wherein Region III comprises a modification of the heptad repeat overlapping the glutamine-rich or acid-rich motifs.

* * * * *